(12) United States Patent
Chen et al.

(10) Patent No.: US 11,795,232 B2
(45) Date of Patent: Oct. 24, 2023

(54) ENGINEERED TRANSFERRIN RECEPTOR BINDING POLYPEPTIDES

(71) Applicant: Denali Therapeutics Inc., South San Francisco, CA (US)

(72) Inventors: Xiaocheng Chen, South San Francisco, CA (US); Mark S. Dennis, South San Francisco, CA (US); Mihalis Kariolis, South San Francisco, CA (US); Adam P. Silverman, South San Francisco, CA (US); Ankita Srivastava, South San Francisco, CA (US); Ryan J. Watts, South San Francisco, CA (US); Robert C. Wells, South San Francisco, CA (US); Joy Yu Zuchero, South San Francisco, CA (US)

(73) Assignee: Denali Therapeutics Inc., South San Francisco, CA (US)

( * ) Notice: Subject to any disclaimer, the term of this patent is extended or adjusted under 35 U.S.C. 154(b) by 153 days.

(21) Appl. No.: 16/543,332

(22) Filed: Aug. 16, 2019

(65) Prior Publication Data

US 2020/0223935 A1 Jul. 16, 2020

Related U.S. Application Data

(63) Continuation of application No. PCT/US2018/018371, filed on Feb. 15, 2018.

(60) Provisional application No. 62/583,314, filed on Nov. 8, 2017, provisional application No. 62/543,658, filed on Aug. 10, 2017, provisional application No. 62/460,692, filed on Feb. 17, 2017.

(51) Int. Cl.
*C07K 16/28* (2006.01)
*C07K 16/00* (2006.01)

(52) U.S. Cl.
CPC ........ *C07K 16/2881* (2013.01); *C07K 16/005* (2013.01); *C07K 2317/35* (2013.01); *C07K 2317/524* (2013.01); *C07K 2317/526* (2013.01); *C07K 2317/55* (2013.01)

(58) Field of Classification Search
None
See application file for complete search history.

(56) References Cited

U.S. PATENT DOCUMENTS

| | | | |
|---|---|---|---|
| 5,154,924 A | 10/1992 | Friden | |
| 5,254,342 A | 10/1993 | Shen et al. | |
| 5,527,527 A | 6/1996 | Friden | |
| 5,821,333 A | 10/1998 | Carter et al. | |
| 6,737,056 B1 | 5/2004 | Presta | |
| 6,743,893 B2 | 6/2004 | Engler et al. | |
| 7,241,449 B1 | 7/2007 | Myers et al. | |
| 7,371,826 B2 | 5/2008 | Presta | |
| 7,670,600 B2 | 3/2010 | Dall'Acqua et al. | |
| 7,741,446 B2 | 6/2010 | Pardridge et al. | |
| 7,744,879 B2 | 6/2010 | Shusta et al. | |
| 8,053,567 B2 | 11/2011 | Pardridge et al. | |
| 8,084,254 B2 | 12/2011 | Couraud et al. | |
| 8,088,376 B2 | 1/2012 | Chamberlain et al. | |
| 8,293,495 B2 | 10/2012 | Shusta et al. | |
| 8,313,924 B2 | 11/2012 | Jensen et al. | |
| 8,394,925 B2 | 3/2013 | Chamberlain et al. | |
| 8,417,465 B2 | 4/2013 | Prabhakarpandian et al. | |
| 8,475,792 B2 | 7/2013 | Dall'Acqua et al. | |
| 8,497,246 B2 | 7/2013 | Pardridge et al. | |
| 8,609,065 B2 | 12/2013 | Kuik-Romeijn et al. | |
| 8,753,610 B2 | 6/2014 | Pardridge et al. | |
| 8,759,297 B2 | 6/2014 | Pardridge et al. | |
| 8,859,738 B2 | 10/2014 | Himmler et al. | |
| 8,900,865 B2 | 12/2014 | Harlow et al. | |
| 8,921,279 B2 | 12/2014 | Himmler et al. | |
| 9,005,973 B2 | 4/2015 | Cost et al. | |
| 9,133,274 B2 | 9/2015 | Himmler et al. | |
| 9,156,889 B2 | 10/2015 | Nomoto et al. | |
| 9,513,280 B2 | 12/2016 | Kim et al. | |
| 9,611,323 B2 | 4/2017 | Dennis et al. | |
| 9,708,406 B2 | 7/2017 | Zhang et al. | |
| 9,803,023 B2 | 10/2017 | Chamberlain et al. | |
| 9,856,311 B2 | 1/2018 | Ruker et al. | |
| 9,890,209 B2 | 2/2018 | Kaluza et al. | |
| 9,993,564 B2 | 6/2018 | Freskgard et al. | |
| 9,994,641 B2 | 6/2018 | Sonoda et al. | |
| 10,143,187 B2 | 12/2018 | Dennis et al. | |
| 10,144,783 B2 | 12/2018 | Pardridge et al. | |
| 10,233,252 B2 | 3/2019 | Shusta et al. | |
| 10,251,952 B2 | 4/2019 | Bader et al. | |
| 10,323,089 B2 | 6/2019 | Dengl et al. | |

(Continued)

FOREIGN PATENT DOCUMENTS

| | | |
|---|---|---|
| CN | 101098891 A | 1/2008 |
| EP | 2546268 A1 | 1/2013 |
| EP | 2568051 A1 | 3/2013 |
| EP | 2842969 A1 | 3/2015 |
| WO | 1991/04753 | 4/1991 |
| WO | 1991/005038 A1 | 4/1991 |
| WO | 1994/028121 A1 | 12/1994 |

(Continued)

OTHER PUBLICATIONS

Uniprot "P23088" accessed from uniprot.org on Mar. 10, 2022 (Year: 1991).*

(Continued)

*Primary Examiner* — Adam Weidner

(74) *Attorney, Agent, or Firm* — Kilpatrick Townsend & Stockton LLP

(57) ABSTRACT

Provided herein are polypeptides that bind to a transferrin receptor, methods of generating such polypeptides, and methods of using the polypeptides to target a composition to a transferrin receptor-expressing cell.

38 Claims, 69 Drawing Sheets

Specification includes a Sequence Listing.

(56) References Cited

U.S. PATENT DOCUMENTS

| | | |
|---|---|---|
| 10,364,292 B2 | 7/2019 | Rueger et al. |
| 10,385,118 B2 | 8/2019 | Himmler et al. |
| 10,457,717 B2 | 10/2019 | Chen et al. |
| 10,508,151 B2 | 12/2019 | Zhang et al. |
| 10,759,864 B2 | 9/2020 | Sonoda et al. |
| 10,808,036 B2 | 10/2020 | Zhang et al. |
| 10,870,837 B2 | 12/2020 | Henry et al. |
| 11,008,403 B2 | 5/2021 | Liu et al. |
| 11,111,308 B2 | 9/2021 | Sonoda et al. |
| 11,124,567 B2 | 9/2021 | Dennis et al. |
| 11,155,631 B2 | 10/2021 | Pardridge et al. |
| 2002/0115824 A1 | 8/2002 | Engler et al. |
| 2003/0074141 A1 | 4/2003 | Russell |
| 2005/0106658 A1 | 5/2005 | DeFrees et al. |
| 2005/0170394 A1 | 8/2005 | Zerangue |
| 2006/0193776 A1 | 8/2006 | Goldsmith et al. |
| 2010/0009863 A1 | 1/2010 | Himmler et al. |
| 2010/0048877 A1 | 2/2010 | Ruker et al. |
| 2010/0273200 A1 | 10/2010 | Niwa et al. |
| 2012/0276125 A1 | 11/2012 | Ast et al. |
| 2012/0282176 A1 | 11/2012 | Bohrmann et al. |
| 2013/0318641 A1 | 11/2013 | Bradley et al. |
| 2013/0318643 A1 | 11/2013 | Bradley et al. |
| 2014/0142370 A1 | 5/2014 | Wong et al. |
| 2014/0199294 A1 | 7/2014 | Mimoto et al. |
| 2014/0212423 A1 | 7/2014 | Hanzatian et al. |
| 2014/0295547 A1 | 10/2014 | Kuo et al. |
| 2014/0348754 A1 | 11/2014 | Wiley et al. |
| 2014/0356381 A1 | 12/2014 | Moore et al. |
| 2015/0044140 A1 | 2/2015 | Lledo et al. |
| 2015/0094451 A1 | 4/2015 | Fischer et al. |
| 2015/0110791 A1 | 4/2015 | Zhang et al. |
| 2015/0166636 A1 | 6/2015 | Igawa et al. |
| 2015/0196663 A1 | 7/2015 | Shusta et al. |
| 2015/0210763 A1 | 7/2015 | Kuramochi et al. |
| 2015/0322149 A1 | 11/2015 | Bohrmann et al. |
| 2015/0329636 A1 | 11/2015 | Dennis et al. |
| 2015/0344570 A1 | 12/2015 | Igawa et al. |
| 2015/0353639 A1 | 12/2015 | Watts et al. |
| 2016/0002343 A1 | 1/2016 | Hanzatian et al. |
| 2016/0032000 A1 | 2/2016 | Ghayur et al. |
| 2016/0040125 A1 | 2/2016 | Da Silva Ferreira et al. |
| 2016/0102135 A1 | 4/2016 | Escobar-Cabrera |
| 2016/0168253 A1 | 6/2016 | Bohrmann et al. |
| 2016/0208008 A1 | 7/2016 | Alper |
| 2016/0271269 A1 | 9/2016 | Moghimi et al. |
| 2016/0324984 A1 | 11/2016 | Brinkmann et al. |
| 2017/0218085 A1 | 8/2017 | Geierstanger et al. |
| 2018/0171012 A1 | 6/2018 | Sonoda et al. |
| 2018/0179291 A1 | 6/2018 | Sonoda et al. |
| 2018/0222992 A1 | 8/2018 | Duerr et al. |
| 2018/0222993 A1 | 8/2018 | Duerr et al. |
| 2018/0235195 A1 | 8/2018 | Dennis et al. |
| 2018/0237496 A1 | 8/2018 | Chen et al. |
| 2018/0291110 A1 | 10/2018 | Klein et al. |
| 2018/0344869 A1 | 12/2018 | Fischer et al. |
| 2019/0274291 A1 | 9/2019 | Dennis et al. |
| 2019/0338043 A1 | 11/2019 | Sonoda et al. |
| 2020/0216522 A1 | 7/2020 | Chen et al. |
| 2020/0262890 A1 | 8/2020 | Chen et al. |
| 2020/0277373 A1 | 9/2020 | Chen et al. |
| 2020/0277584 A1 | 9/2020 | Astarita et al. |
| 2020/0289627 A1 | 9/2020 | Dennis et al. |
| 2020/0317749 A1 | 10/2020 | Dennis et al. |
| 2020/0369746 A1 | 11/2020 | Chen et al. |
| 2020/0384061 A1 | 12/2020 | Sonoda et al. |
| 2021/0070881 A1 | 3/2021 | Dennis et al. |
| 2021/0087288 A1 | 3/2021 | Zhang et al. |
| 2021/0130485 A1 | 5/2021 | Dennis et al. |
| 2021/0188925 A1 | 6/2021 | Cherf et al. |
| 2021/0198640 A1 | 7/2021 | Astarita et al. |
| 2021/0214438 A1 | 7/2021 | Dennis et al. |
| 2021/0269543 A1 | 9/2021 | Sonoda et al. |
| 2021/0284702 A1 | 9/2021 | Di Paolo et al. |
| 2021/0396772 A1 | 12/2021 | Astarita et al. |
| 2022/0002436 A1 | 1/2022 | Dennis et al. |
| 2022/0017634 A1 | 1/2022 | Kannan et al. |
| 2022/0025065 A1 | 1/2022 | Arguello et al. |
| 2022/0177576 A1 | 6/2022 | Dennis et al. |
| 2022/0184186 A1 | 6/2022 | Anderson et al. |
| 2022/0213155 A1 | 7/2022 | Cherf et al. |
| 2022/0220172 A1 | 7/2022 | Cherf et al. |

FOREIGN PATENT DOCUMENTS

| | | |
|---|---|---|
| WO | 1999/000150 A2 | 1/1999 |
| WO | 2001/016181 A2 | 3/2001 |
| WO | 2001/059459 A2 | 8/2001 |
| WO | 2001/064849 A1 | 9/2001 |
| WO | 2002/060919 A2 | 8/2002 |
| WO | 2003/003007 A2 | 1/2003 |
| WO | 2004/020404 A2 | 3/2004 |
| WO | 2004/063351 A2 | 7/2004 |
| WO | 2004/094647 A2 | 11/2004 |
| WO | 2005/077981 A2 | 8/2005 |
| WO | 2009/099961 A2 | 8/2009 |
| WO | 2010/014622 A2 | 2/2010 |
| WO | 2010/106180 A2 | 9/2010 |
| WO | 2010/121766 A1 | 10/2010 |
| WO | 2011/122011 A2 | 10/2011 |
| WO | 2011/131746 A2 | 10/2011 |
| WO | 2012/058768 A1 | 5/2012 |
| WO | 2012/075037 A1 | 6/2012 |
| WO | 2012/125850 A1 | 9/2012 |
| WO | 2012/143379 A1 | 10/2012 |
| WO | 2012/143523 A1 | 10/2012 |
| WO | 2013/091637 A1 | 6/2013 |
| WO | 2013/138400 A1 | 9/2013 |
| WO | 2013/138643 A1 | 9/2013 |
| WO | 2013/177062 A2 | 11/2013 |
| WO | 2013/184514 A1 | 12/2013 |
| WO | 2014/033074 A1 | 3/2014 |
| WO | 2014/074695 A1 | 5/2014 |
| WO | 2014/177459 A2 | 11/2014 |
| WO | 2014/189973 A2 | 11/2014 |
| WO | 2014/190441 A9 | 12/2014 |
| WO | 2015/014884 A1 | 2/2015 |
| WO | 2015/075011 A1 | 5/2015 |
| WO | 2015/101586 A1 | 7/2015 |
| WO | 2016/038123 A1 | 3/2016 |
| WO | 2016/077840 A2 | 5/2016 |
| WO | 2016/079081 A1 | 5/2016 |
| WO | 2016/081640 A1 | 5/2016 |
| WO | 2016/081643 A1 | 5/2016 |
| WO | 2016/090486 A1 | 6/2016 |
| WO | 2016/202343 A1 | 12/2016 |
| WO | 2016/207240 A1 | 12/2016 |
| WO | 2016/208695 A1 | 12/2016 |
| WO | 2017/007796 A1 | 1/2017 |
| WO | 2017/035119 A1 | 3/2017 |
| WO | 2017/134197 A1 | 8/2017 |
| WO | 2017/193032 A9 | 11/2017 |
| WO | 2018/011353 A1 | 1/2018 |
| WO | 2018/031424 A1 | 2/2018 |
| WO | 2018/117613 A1 | 6/2018 |
| WO | 2018/175383 A1 | 9/2018 |
| WO | 2019/089395 A1 | 5/2019 |
| WO | 2019/190293 A1 | 10/2019 |
| WO | 2020/056327 A1 | 3/2020 |
| WO | 2020/081575 A1 | 4/2020 |
| WO | 2020/112889 A2 | 6/2020 |
| WO | 2020/123511 A2 | 6/2020 |
| WO | 2020/206320 A1 | 10/2020 |
| WO | 2021/158986 A1 | 8/2021 |
| WO | 2021/168194 A1 | 8/2021 |
| WO | 2022/081765 A1 | 4/2022 |

OTHER PUBLICATIONS

Clarke "A single domain shark antibody targeting the transferrin receptor 1 delivers a TrkB agonist antibody across the blood brain barrier to provide full neuroprotection in a mouse model of Par-

(56) References Cited

OTHER PUBLICATIONS kinson's Disease" accessed from biorxiv.org on Mar. 10, 2022 (Year: 2021).*

Abraham et al., "Structural basis for receptor recognition by New World hemorrhagic fever arenaviruses," Nat. Struct. Mol. Biol., 2010, advanced online publication, pp. 1-8.

Alvarez et al., "Intermolecular disulfide bonds are not required for the expression of the dimeric state and functional activity of the transferrin receptor," The EMBO Journal, 1989, vol. 8, No. 8, pp. 2231-2240.

Atwal et al., "A Therapeutic Antibody Targeting BACE1 Inhibits Amyloid-β Production in Vivo," Sci Transl. Med., May 25, 2011, vol. 3, Issue 84, pp. 1-12.

Baird et al. "Circular permutation and receptor insertion within green fluorescent proteins", Proc. Natl. Acad. Sci. USA, Sep. 1999, vol. 96, pp. 11241-11246.

Banks, "Mouse Models of Neurological Disorders: A View From the Blood-brain Barrier," Biochim Biophys Acta, 1802(10):881-888, 2010.

Buchegger et al., "Functional analysis of human/chicken transferrin receptor chimeras indicates that the carboxy-terminal region is important for ligand binding," Eur. J. Biochem. 1996, vol. 235, pp. 9-17.

Chen et al., "Protein-protein interactions: General trends in the relationship between binding affinity and interfacial buried surface area", The Protein Society, Feb. 7, 2013, pp. 510-515.

Cheng et al. "Structure of the Human Transferrin Receptor-Transferrin Complex", Cell Press, Feb. 20, 2004, vol. 116, pp. 565-576.

Database Geneseq [Online], Feb. 3, 2011 (Feb. 3, 2011), "Immunostimulatory fusion protein production related protein, SEQ ID 6," retrieved from EBI accession No. GSP:AYM52804, Database accession No. AYM52804, 2 pages.
Denali Therapeutics Inc., "F-star Announces Collaborative Agreement with Denali Therapeutics for the Development of a Multispecific Antibody Platform to Deliver Therapeutics Across the Blood-Brain Barrier", F-Star, 3 pages.
Denali Therapeutics Inc., Form S-1 Registration Statement, as filed with the U.S. Securities and Exchange Commission on Nov. 13, 2017, retrieved online at <https://www.sec.gov/Archives/edgar/data/1714899/000119312517340997/d445892ds1.htm> on Mar. 20, 2018, 291 pages.
Dominguez et al., "Beyond editing: repurposing CRISPR-Cas9 for precision genome regulation and interrogation," Nature Rev. Molec Cell. Biol., 2016, vol. 17, pp. 5-15.
Eckenroth et al., "How the binding of human transferrin primes the transferrin receptor potentiating iron release at endosomal pH," Proceedings of the National Academy of Sciences, 2011, vol. 108, No. 32, pp. 13089-13094.
Haqqani et al. "Intracellular sorting and Transcytosis of the rat transferrin receptor antibody OX26 across the blood-brain barrier in vitro is dependent on its binding affinity" Journal of Neurochemistry, 2018, vol. 146, pp. 735-752.
Ji et al., "Efficient creation of an APOE knockout rabbit," Transgenic Res., 2015, vol. 24, pp. 227-235.
Kariolis et al. "Brain delivery of therapeutic proteins using an Fc fragment blood-brain barrier transport vehicle in mice and monkeys", Science Translational Medicine, May 27, 2020, Downloaded from http://stm.sciencemag.org/, pp. 1-13.
Lawrence et al., "Crystal Structure of the Ectodomain of Human Transferrin Receptor," Science, 1999, vol. 286, pp. 779-782.
Li et al., "Production of Genetically Engineered Golden Syrian Hamsters by Pronuclear Injection of the CRISPR/Cas9 Complex," J. Vis. Exp., 2018, vol. 9, No. 131, pp. 1-8.
Liu et al., "Fc Engineering for developing therapeutic bispecific antibodies and novel scaffolds," Frontiers in Immunology, Jan. 26, 2017, vol. 8, Article 38, pp. 1-15.
Lobner et al., "Engineered IgGI-Fc—ne fragment to bind them all," Immunological Reviews, 2016, vol. 270, No. 1, pp. 113-131.
Ma et al., "Generation of eGFP and Cre knockin rats by CRISPR/Cas9," FEBS Journal, 2016, vol. 281, pp. 3779-3790.
Mager et al., "Targeting blood-brain-barriertranscytosis e perspectives for drug delivery", Elsevier, 2017, vol. 120, pp. 4-7.
Marri et al., "Human Biochemistry", Moscow "Mir", 1993, v. 1, 3 pages.
McGraw et al., "Functional Expression of the Human Transferrin Receptor cDNA in Chinese Hamster Ovary Cells Deficient in Endogenous Transferrin Receptor," J. Cell Biology, 1987, vol. 105, pp. 207-214.
Milstone et al., "Stratum-Specific Expression of Human Transferrin Receptor Increases Iron in Mouse Epidermas," J. Invest. Dermatol, 126:648-652, 2006.
Mizutani et al., "Transferrin Receptor 1 Facilitates Poliovirus Permeation of Mouse Brain Capillary Endothelial Cells," Journal of Biological Chemistry, 2016, vol. 291, No. 6, pp. 2829-2836.
Naito et al., "Expression of exogenous DNA in the gonads of chimaeric chicken embryos produced by transfer of primordial germ cells transfected in vitro and subsequent fate of the introduced Dna," J. Reprod. Fert.,1998, vol. 113, pp. 137-143.
Palermo et al., "Residues in the Apical Domain of the Feline and Canine Transferrin Receptors Control Host-Specific Binding and Cell Infection of Canine and Feline Parvoviruses," Journal of Virology, 2003, vol. 77, No. 16, pp. 8915-8923.
Pardridge et al., "Blood-brain barrier drug delivery of IgG fusion proteins with a transferrin receptor monoclonal antibody," Expert Opinion on Drug Deliv., 2015, vol. 12, Issue 2, pp. 207-222.
Park et al., "The Highly Evolvable Antibody Fc Domain," Trends in Biotechnology, 2016, vol. 34, No. 11, pp. 895-908.
Raina, A. et al., "Testis mediated gene transfer: In vitro transfection in goat testis by electroporation," Gene, 2015, vol. 554, pp. 96-100.
Ramírez-Solis et al., "Gene Targeting in Embryonic Stem Cells," Methods in Enzymology, 225:855-878, 1993.
Sohet et al., "Genetic mouse models to study blood-brain barrier development and function," Fluids and Barriers of the CNS, 2013, vol. 10, No. 3, pp. 1-18.
Ullman et al., "Brain delivery and activity of a lysosomal enzyme using a blood-brain barrier transport vehicle in mice", Science Translational Medicine, May 27, 2020, Downloaded from http://stm.sciencemag.org/, pp. 1-13.
Wen et al. "Soluble Form of Canine Transferrin Receptor Inhibits Canine Parvovirus Infection In Vitro and In Vivo," BioMed Research Intl., 2013, vol. 2013, pp. 1-8.
Winnard. et al., "Development of novel chimeric transmembrane proteins for multimodality imaging of cancer cells," Cancer Biol. & Ther., 2007, vol. 6, No. 12, pp. 1889-1899.
Wozniak-Knopp et al., "Introducing antigen-binding sites in structural loops of immunoglobulin constant domains: Fc fragments with engineered HER2/neu-binding sites and antibody properties," Protein Engineering, Design and Selection, 2010, vol. 23, No. 4, pp. 289-297.
Wozniak-Knopp et al., "Stabilisation of the Fc Fragment of Human IgG1 by Engineered Intradomain Disulfide Bonds", Plos One, Jan. 2012, vol. 7, Issue 1, pp. 1-11.
Yu et al., "Therapeutic bispecific antibodies cross the blood-brain barrier in nonhuman primates," Science Translational Medicine, 2014, vol. 6, Issue 261, pp. 1-10.
Yu et al., "Boosting Brain Uptake of a Therapeutic Antibody by Reducing Its Affinity for a Transcytosis Target", Science Translational Medicine, May 25, 2011, vol. 3, No. 84, pp. 1-9.
International Search Report and Written Opinion received for International Application No. PCT/US2018/018371, dated Apr. 17, 2018, 21 pages.
International Search Report and Written Opinion received for International Application No. PCT/US2018/046337, dated Nov. 15, 2018, 20 pages.
International Search Report and Written Opinion received for International Application No. PCT/US2018/046199, dated Oct. 25, 2018, 20 pages.
Extended European Search Report received for EP Appl. No. 18843180.3, dated Jun. 4, 2021, 12 pages.

(56) References Cited

OTHER PUBLICATIONS

Lee et al., "Receptor mediated uptake of peptides that bind the human transferrin receptor," Eur. J. Biochem., 268:2004-2012, 2001.
Niewoehner et al., "Increased Brain Penetration and Potency of a Therapeutic Antibody Using a Monovalent Molecular Shuttle," Neuron, 81:49-60, 2014.
Gadkar et al. "Mathematical PKPD and safety model of bispecific TfR/BACE1 antibodies for the optimization of antibody uptake in brain", European Journal of Pharmaceutics and Biopharmaceutics, vol. 101, pp. 53-61, 2016.
Bhattacharya, et al. "Impact of Genetic Variation on Three Dimensional Structure and Function of Proteins", Plos One, vol. 12, No. 3, e0171355, 22 pages, Mar. 15, 2017.
Davies, et al., "Structural Determinants of Unique Properties of Human IgG4-Fc", Journal of Molecular Biology, vol. 426, No. 3, pp. 630-644, 2014.
Fenton, et al. "Rheostat Positions: A New Classification of Protein Positions Relevant to Pharmacogenomics", Medicinal Chemistry Research 29, pp. 1133-1146, 2020.
Guo, et al., "Protein Tolerance to Random Amino Acid Change", Proceedings of the National Academy of Sciences, vol. 101, No. 25, pp. 9205-9210, Jun. 22, 2004.

\* cited by examiner

CH2C. 7

- CH3.17
- CH3.18
- CH3.35
- CH3.3
- Ab204

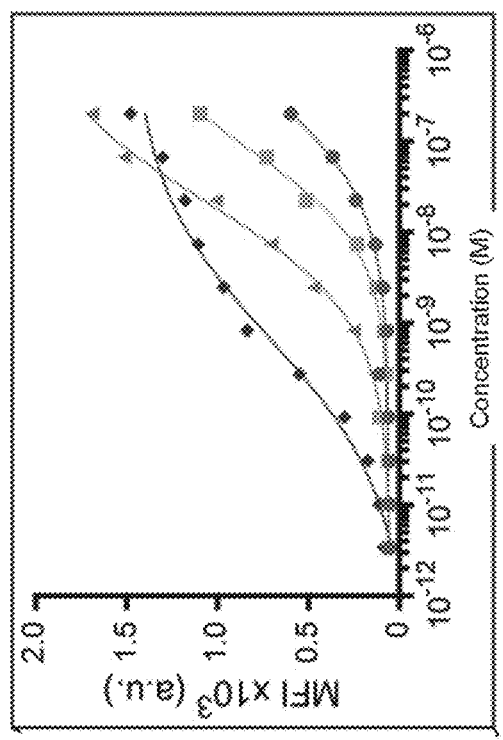
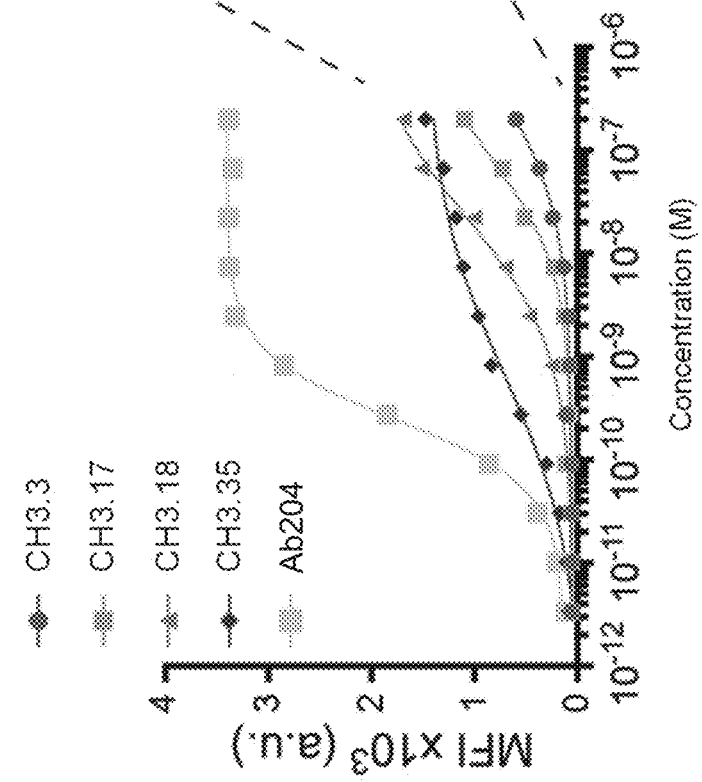
FIG. 13

FIG. 16A
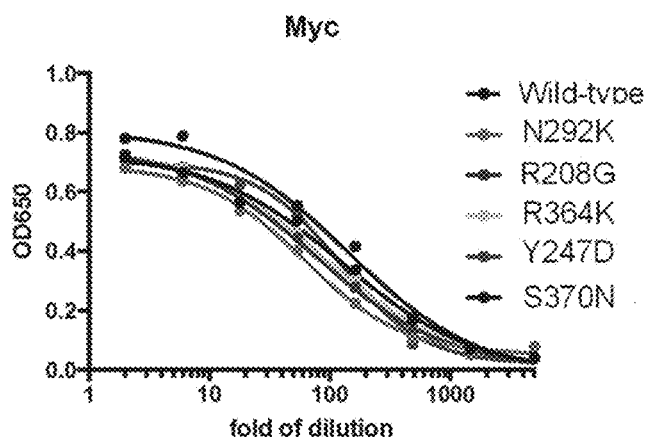
FIG. 16B
FIG. 16C
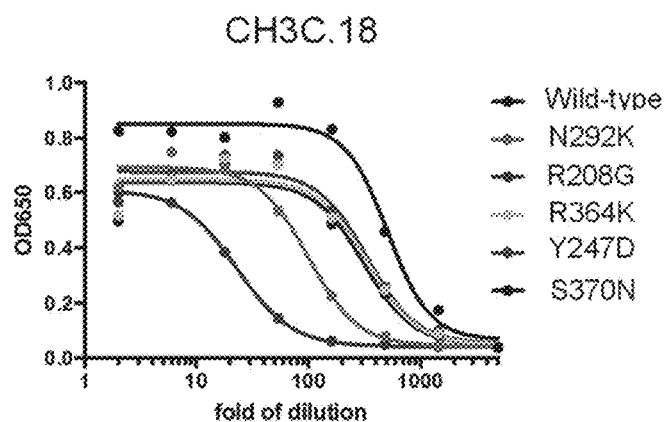 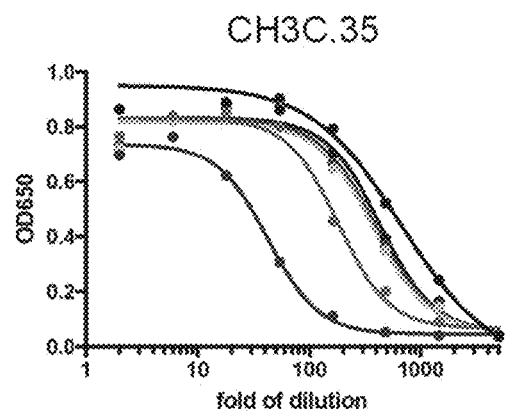
FIG. 16D
FIG. 16E
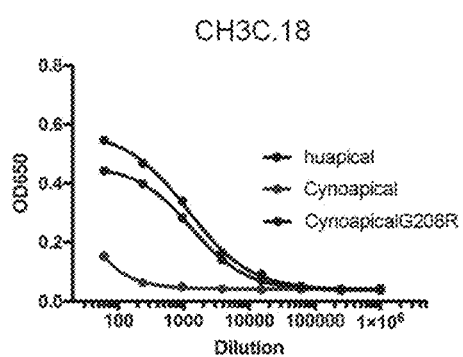 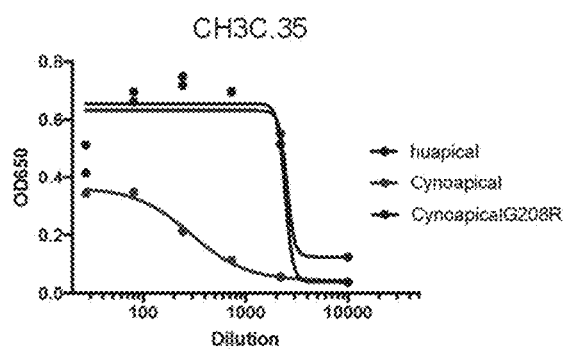

FIG. 18A

Consensus1-35

| Wildtype | E | W | E | S | N | G | Q | P | E | N | N | Y | K | V | D | K | S | R | W | Q | Q | G | N |
|---|---|---|---|---|---|---|---|---|---|---|---|---|---|---|---|---|---|---|---|---|---|---|---|
| Clone 3 |  |  |  |  | Y |  | T | E | W | S | Q |  |  | E |  |  |  | D |  |  |  |  | H |
| 1-35 |  |  |  |  | Y |  | T | E | W | S | S |  |  | T |  |  |  | E |  |  |  |  | F |
| 1-44 |  |  |  |  | Y |  | T | E | W | S | N |  |  | S |  |  |  | E |  |  |  |  | F |
| Library 3.1 |  |  |  |  | X |  | X | E | W | X | X |  |  | X |  |  |  | X |  |  |  |  | X |

FIG. 18B

Consensus1-18

| Wildtype | E | W | E | S | N | G | Q | P | E | N | N | Y | K | V | D | K | S | R | W | Q | Q | G | N |
|---|---|---|---|---|---|---|---|---|---|---|---|---|---|---|---|---|---|---|---|---|---|---|---|
| Clone 4 |  |  |  |  | L |  | L | V | W | V | G |  | Y | A |  |  |  | T |  |  |  |  | W |
| 1-21 |  |  |  |  | L |  | L | V | W | V | G |  |  | P |  |  |  | T |  |  |  |  | W |
| 1-18 |  |  |  |  | L |  | H | V | W | A | V |  |  | P |  |  |  | T |  |  |  |  | W |
| 1-25 |  |  |  |  | M |  | H | V | W | V | G |  |  | D |  |  |  | T |  |  |  |  | W |
| 1-34 |  |  |  |  | L |  | L | V | G | V | F | S |  | P |  |  |  | T |  |  |  |  | W |
| 1-51 |  |  |  |  | L |  | H | V | W | V | G |  |  | S |  |  |  | E |  |  |  |  | W |
| Library 3.2 |  |  |  |  | X/M |  | X/X | V/G | W | X/X | X |  |  | P:50 / X:50 |  |  |  | X |  |  |  |  | W:50 F:25 H:25 Y:25 (L):25 |

FIG. 18C

Gap

| Wildtype | E | W | E | S | N | G | Q | P | E | N | N | Y | K | V | D | K | S | R | W | Q | Q | G | N |
|---|---|---|---|---|---|---|---|---|---|---|---|---|---|---|---|---|---|---|---|---|---|---|---|
| WT | x | W | x |  | N | G | Q | P | E | N | N |  | x | D |  | x |  | R |  |  |  |  | N |
| 1-18 GAP | x |  | x |  | L |  | H | V | W | A | V | x |  | P |  | x |  | T |  |  |  |  | W |
| 1-34 GAP | x |  | x |  | L |  | L | V | G | V | F | x |  | P |  | x |  | T |  |  |  |  | W |
| 1-35 GAP | x |  | x |  | Y |  | T | E | W | S | S | x |  | T |  | x |  | E |  |  |  |  | F |

FIG. 18D

Aromatic

| Wildtype | E | W | E | S | N | G | Q | P | E | N | N | Y | K | V | D | K | S | R | W | Q | Q | G | N |
|---|---|---|---|---|---|---|---|---|---|---|---|---|---|---|---|---|---|---|---|---|---|---|---|
| 1-18 |  |  |  |  | L |  | H | V | W | A | V |  |  | P |  |  |  | T |  |  |  |  | W |
| Library 3.4 |  |  |  |  | X |  | X | V | W | X | X |  |  | P |  |  |  | X |  |  |  |  | W:50 F:25 H:25 Y:25 (L):25 |

CH3C.3.2-1

CH3C.3.2-19

CH3C.3.2-5

CH3C.18

CH3C.35

FIG. 23B (cont.)
Position number: 194
Wild-type sequence: N
CH3C.35.21 sequence: F
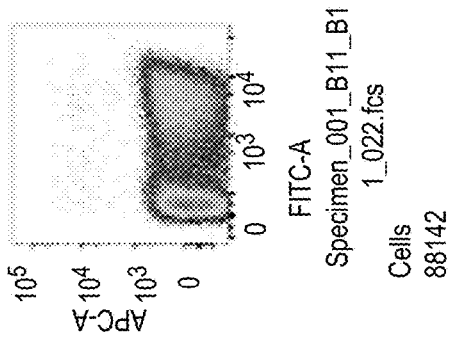
WT reversion
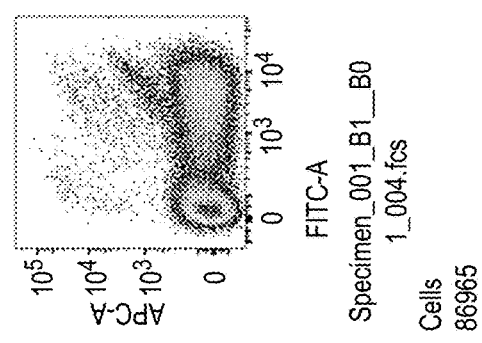
NNK library

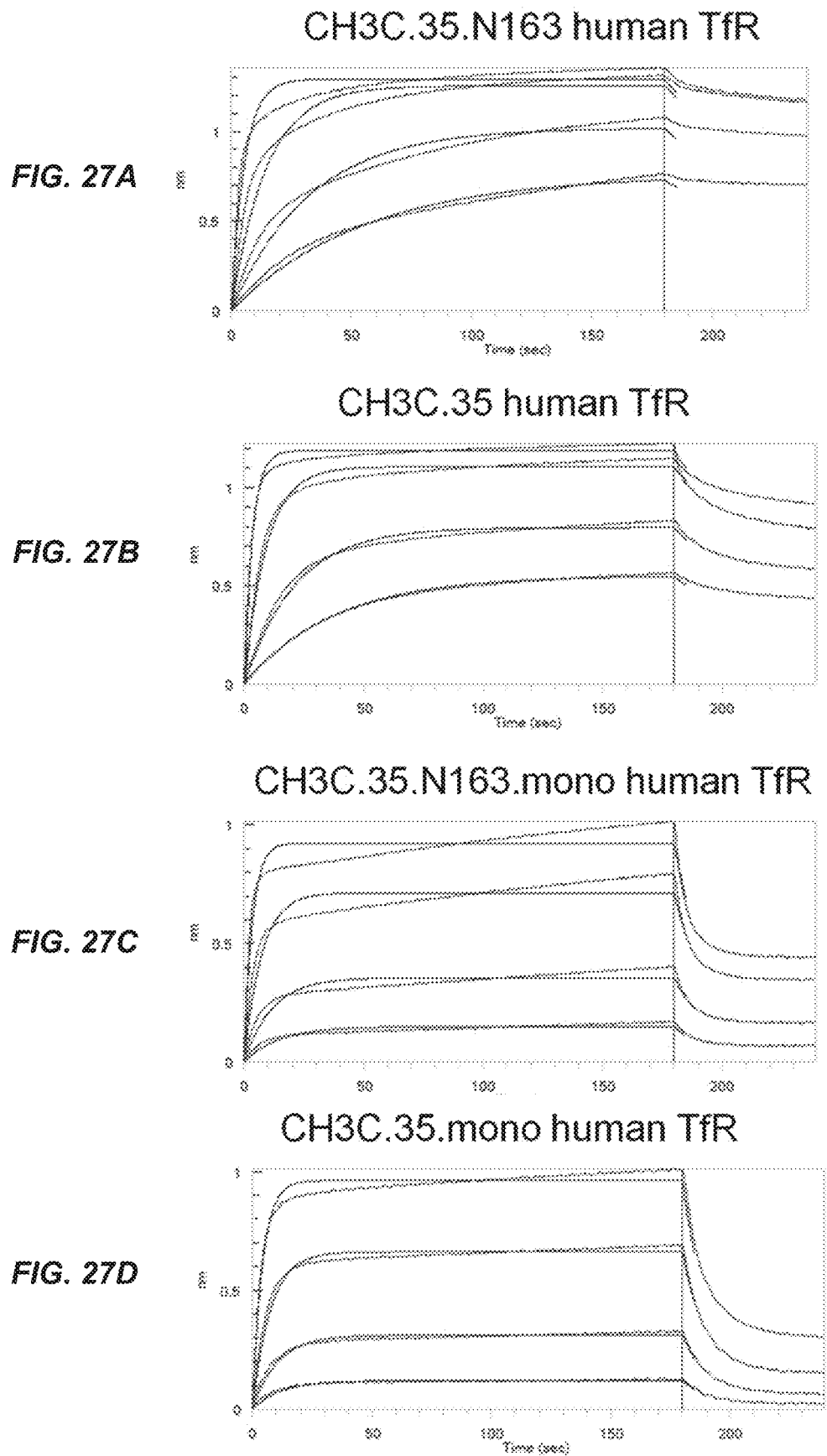
FIG. 27A CH3C.35.N163 human TfR
FIG. 27B CH3C.35 human TfR
FIG. 27C CH3C.35.N163.mono human TfR
FIG. 27D CH3C.35.mono human TfR Low signal Low signal FIG. 29A
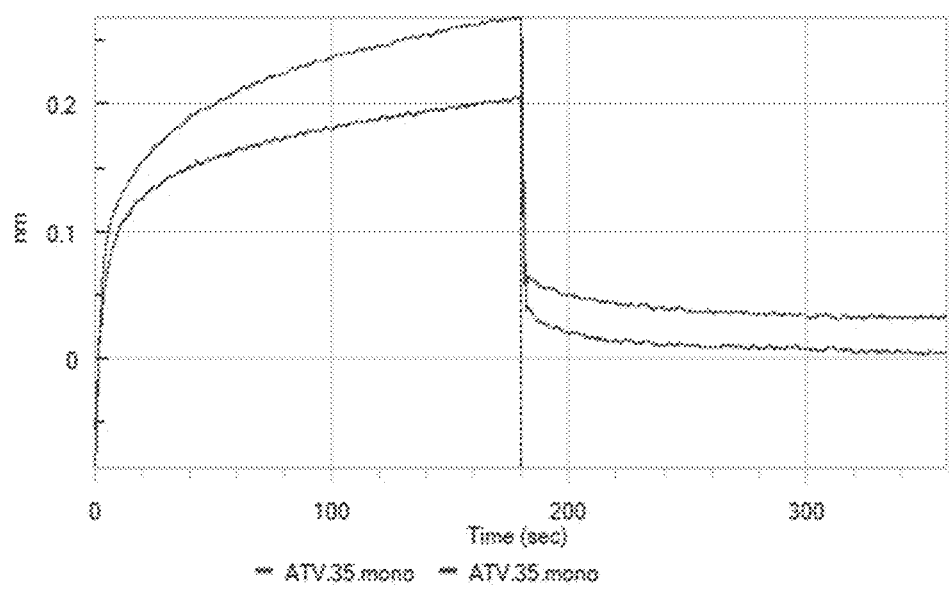
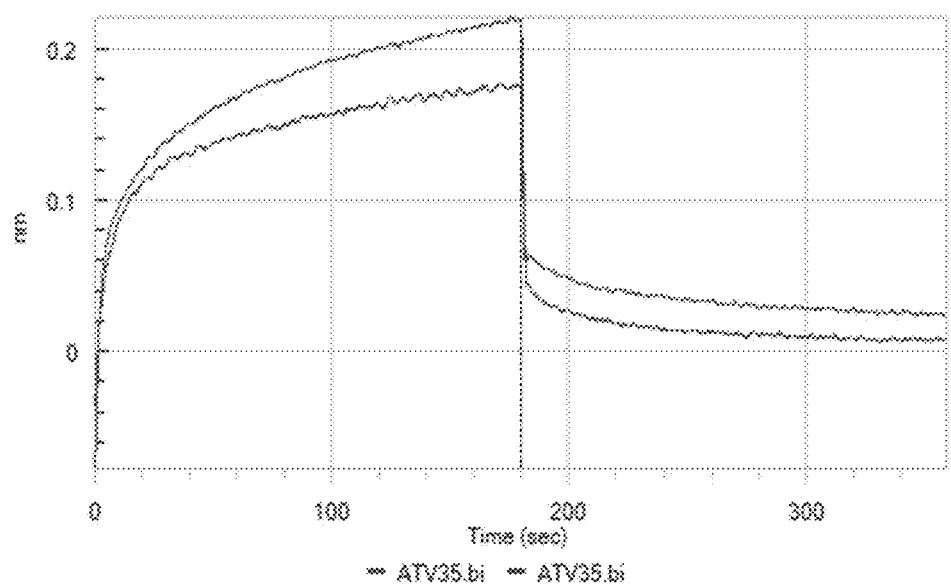

FIG. 29B
CH3C.35.19.mono
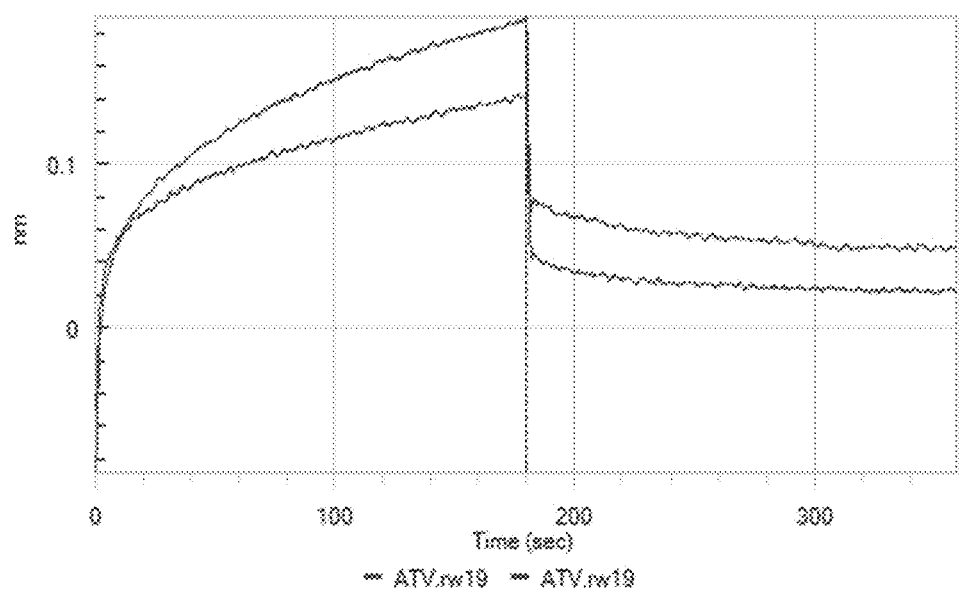
CH3C.35.19.bi
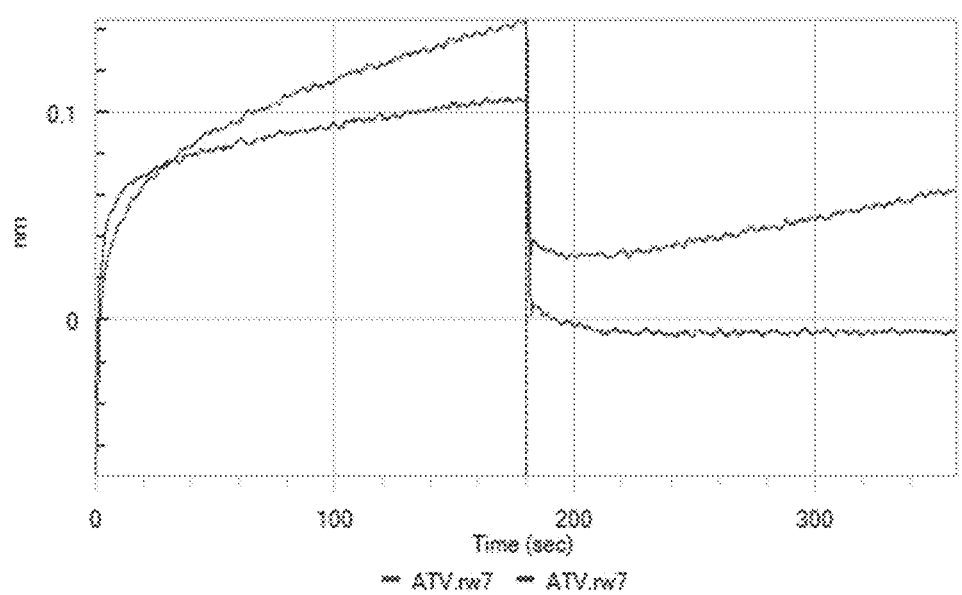

FIG. 29C
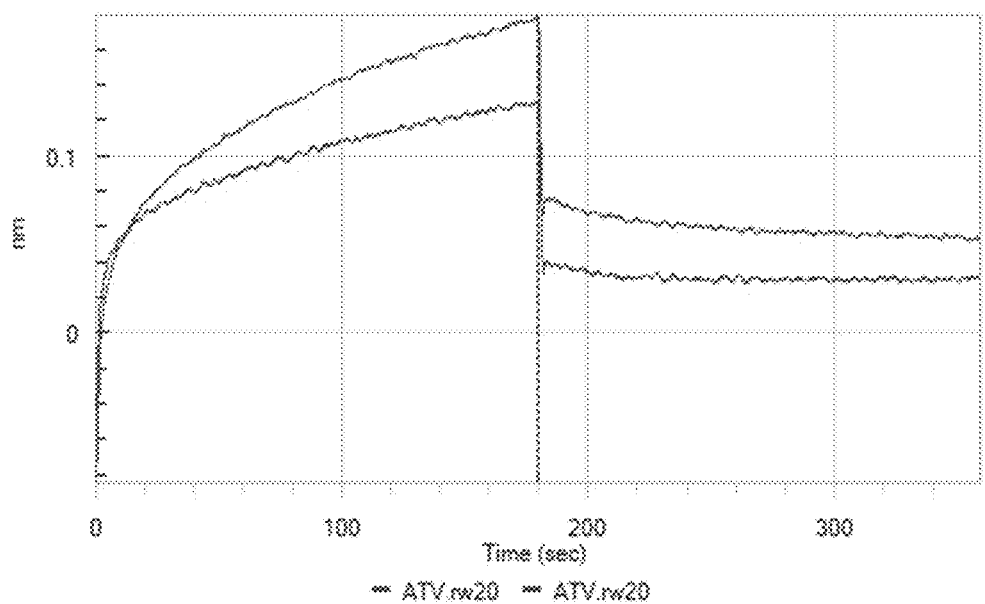
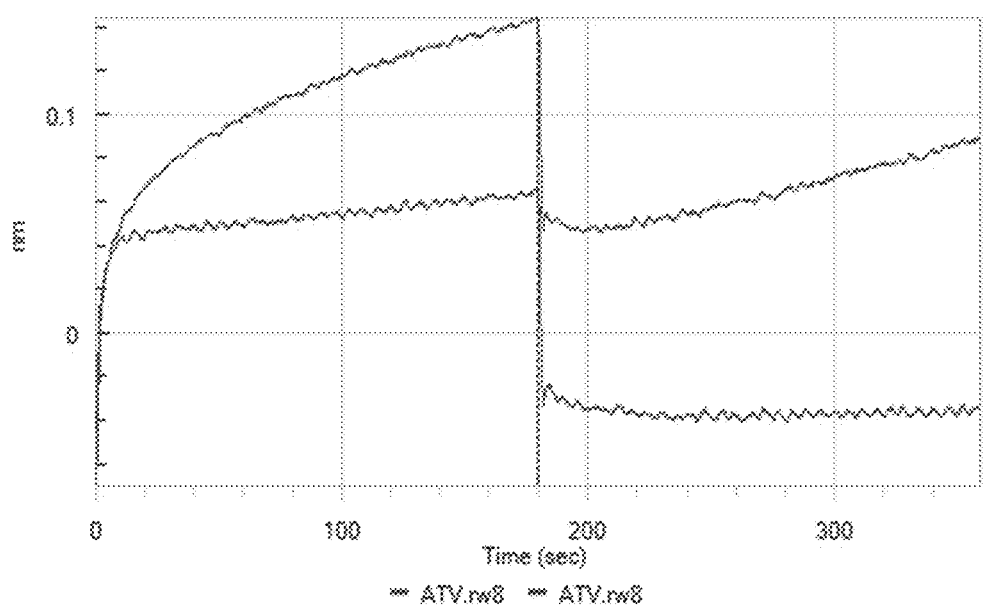

FIG. 29D
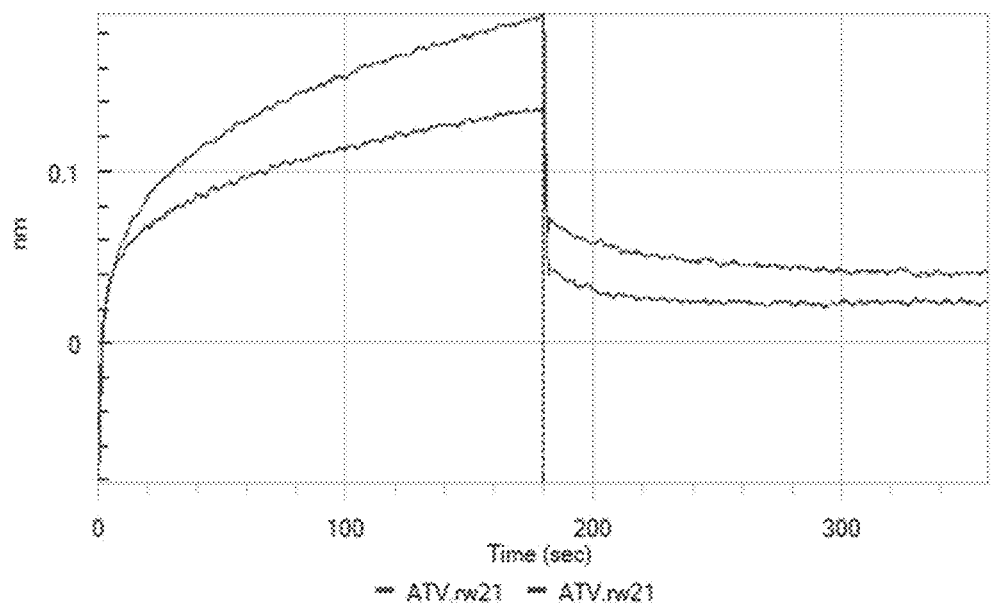
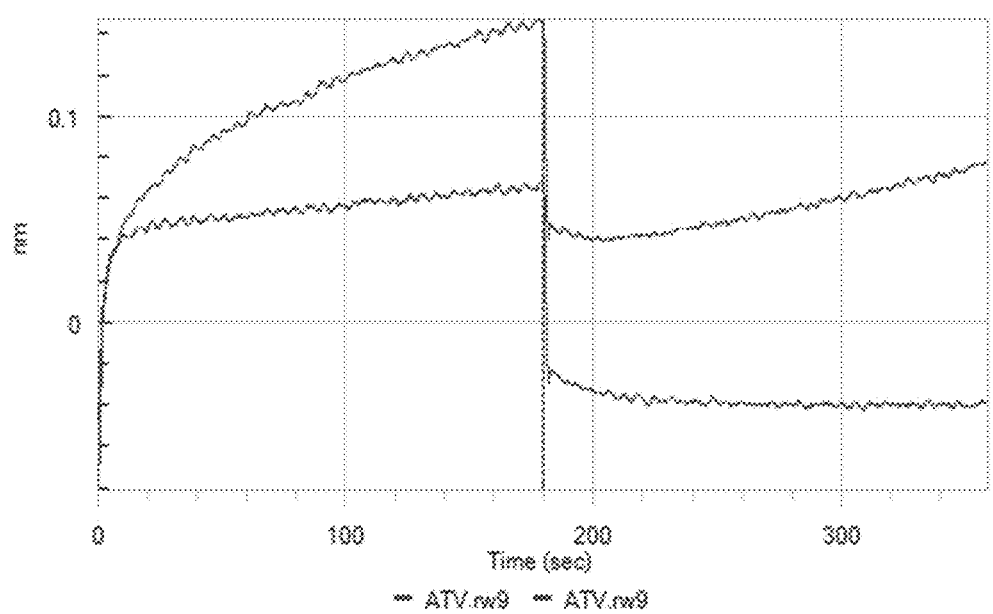

*FIG. 29E*
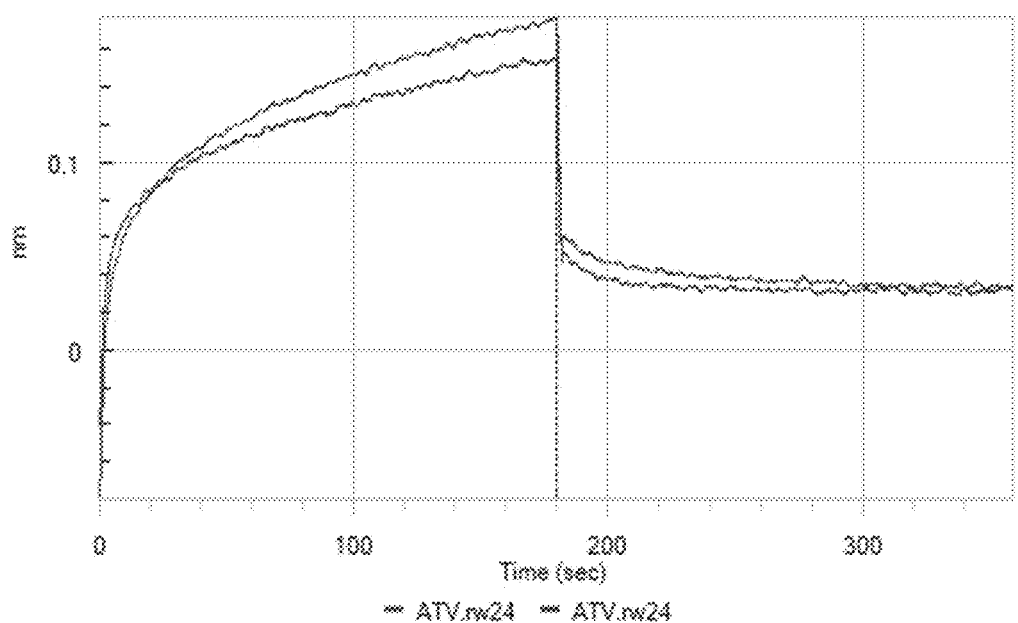
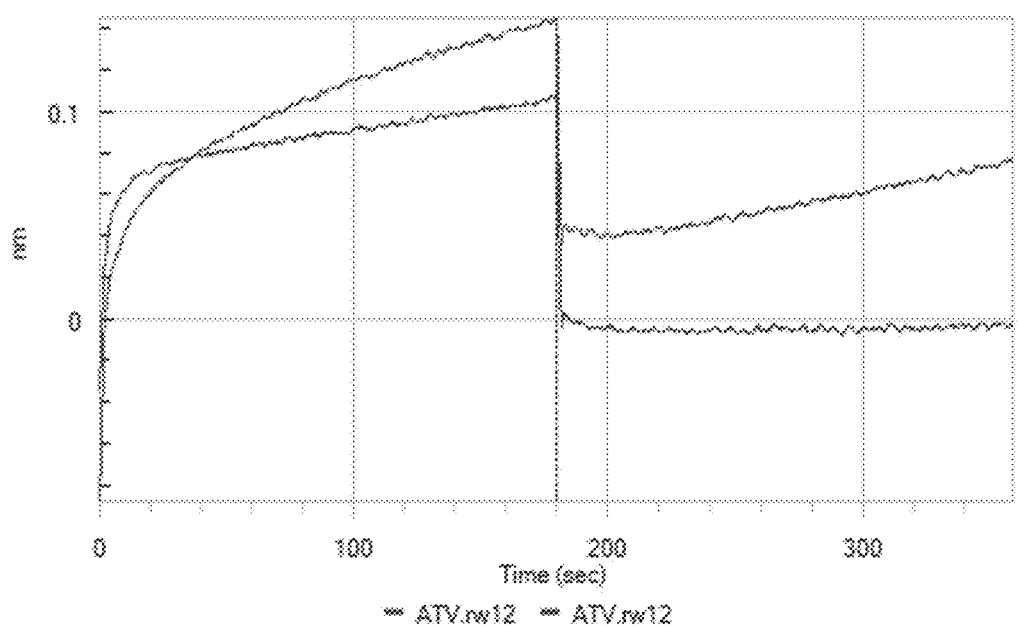

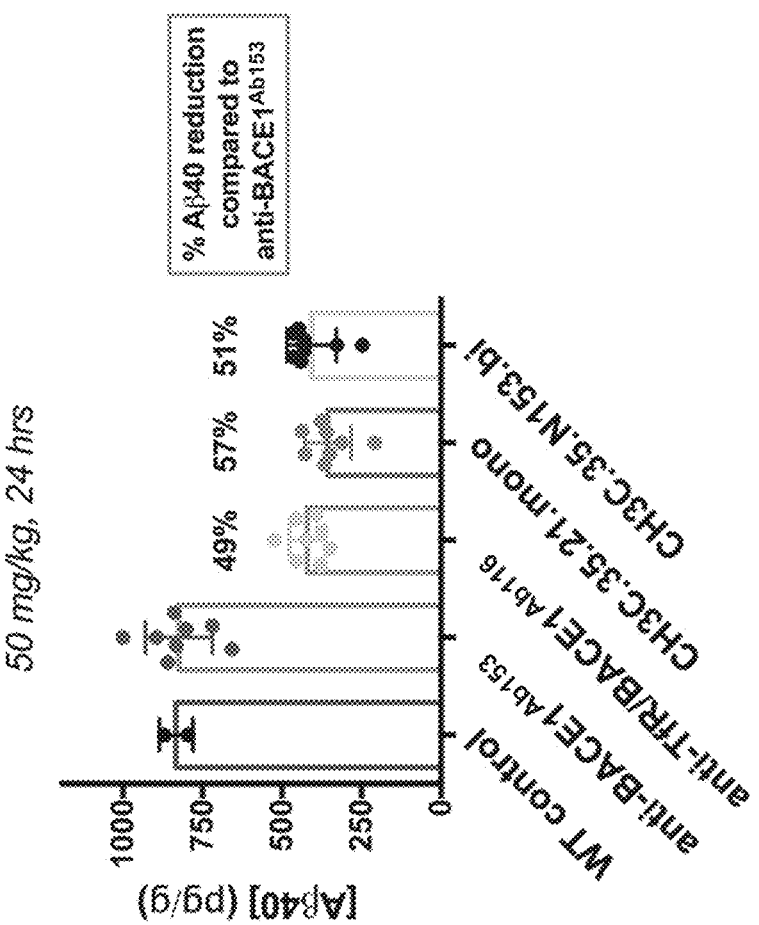
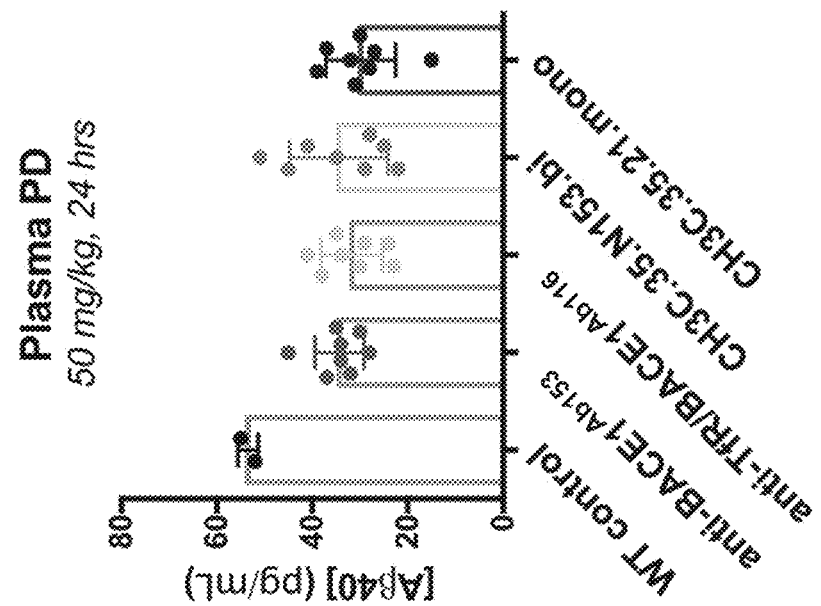

Structural architecture

Binding Surface (within 5 angstroms)

FIG. 38

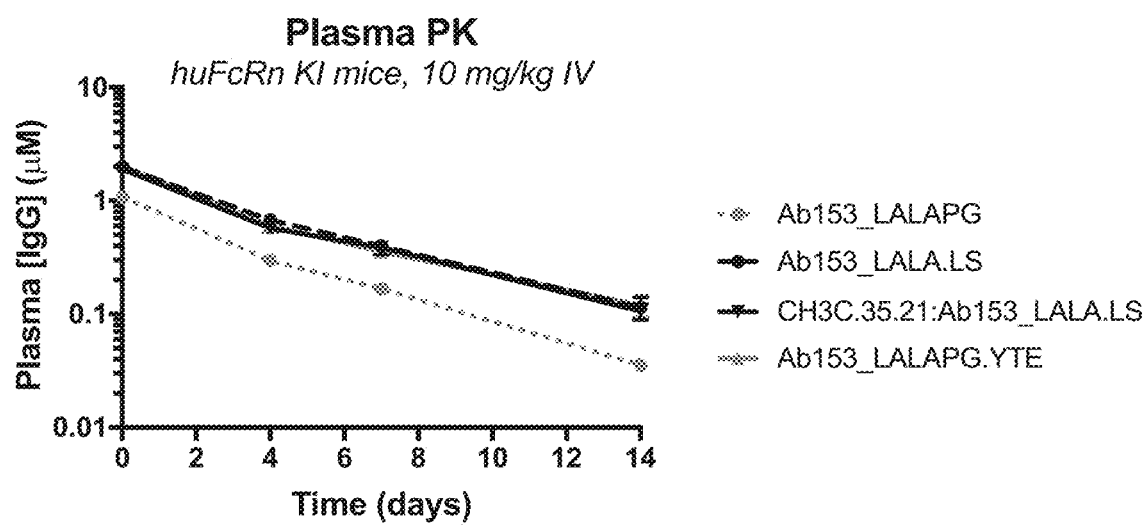

ENGINEERED TRANSFERRIN RECEPTOR BINDING POLYPEPTIDES

CROSS-REFERENCE TO RELATED APPLICATIONS

The present application is a continuation of International Patent Application Serial No. PCT/US2018/018371, filed Feb. 15, 2018, which claims the benefit of and priority to U.S. Patent Application Ser. No. 62/460,692, filed Feb. 17, 2017, U.S. Patent Application Ser. No. 62/543,658, filed Aug. 10, 2017, and U.S. Patent Application Ser. No. 62/583,314, filed Nov. 8, 2017, the contents of which are incorporated herein by reference for all purposes.

BACKGROUND OF THE INVENTION

Various techniques have been developed that engineer a protein to bind to a target that it does not normally bind. For example, libraries can be generated to screen for engineered proteins with desired binding or enzymatic activity.

Transferrin receptor is a carrier protein for transferrin that, among other functions, is needed for the import of iron into the cell and is regulated in response to intracellular iron concentration. Transferrin receptors are expressed on endothelia, including the endothelium of the blood-brain barrier, and are expressed at increased levels on various cancer cells and inflammatory cells. It is one of the receptors that mediates transcytosis of cognate ligands across the blood-brain barrier. Transferrin receptors can thus be desirable targets for introducing an agent into a cell for either endocytosis in the cell or transcytosis across the cell.

BRIEF SUMMARY OF THE INVENTION

We have developed polypeptides that include CH2 and CH3 domains that are capable of binding a transferrin (TfR) receptor. These polypeptides have been engineered with substitutions in the CH2 or CH3 domain that generate a novel TfR binding site. TfR is highly expressed on the blood-brain barrier (BBB), and TfR naturally moves transferrin from the blood into the brain. Because these polypeptides bind TfR, they too can be transported across the BBB and further can be used to transport attached therapeutic agents (e.g., therapeutic polypeptides, antibody variable regions such as Fabs, and small molecules) across the BBB. This approach can substantially improve brain uptake of the therapeutic agents and is therefore highly useful for treating disorders and diseases where brain delivery is advantageous.

In one aspect, polypeptides comprising a modified CH3 domain that specifically binds to a transferrin receptor, wherein the modified CH3 domain comprises four, five, six, seven, eight, or nine substitutions in a set of amino acid positions comprising 157, 159, 160, 161, 162, 163, 186, 189, and 194, and wherein the substitutions and the positions are determined with reference to amino acids 114-220 of SEQ ID NO:1, are provided. In some embodiments, the modified CH3 domain further comprises one, two, three, or four substitutions at positions comprising 153, 164, 165, and 188. In some embodiments, the polypeptide binds to the apical domain of the transferrin receptor. In some embodiments, the polypeptide binds to the transferrin receptor without inhibiting binding of transferrin to the transferrin receptor. In some embodiments, the polypeptide binds to an epitope that comprises amino acid 208 of the transferrin receptor sequence.

In some embodiments, the modified CH3 domain comprises Trp at position 161. In some embodiments, the modified CH3 domain comprises an aromatic amino acid at position 194. In some embodiments, the aromatic amino acid at position 194 is Trp or Phe.

In some embodiments, the modified CH3 domain comprises at least one position selected from the following: position 157 is Leu, Tyr, Met, or Val; position 159 is Leu, Thr, His, or Pro; position 160 is Val, Pro, or an acidic amino acid; position 161 is Trp or Gly; position 162 is Val, Ser, or Ala; position 186 is Glu, Ala, Ser, Leu, Thr, or Pro; position 189 is Thr or an acidic amino acid; and position 194 is Trp, Tyr, His, or Phe. In some embodiments, the modified CH3 domain comprises two, three, four, five, six, seven, or eight positions selected from the following: position 157 is Leu, Tyr, Met, or Val; position 159 is Leu, Thr, His, or Pro; position 160 is Val, Pro, or an acidic amino acid; position 161 is Trp or Gly; position 162 is Val, Ser, or Ala; position 186 is Glu, Ala, Ser, Leu, Thr, or Pro; position 189 is Thr or an acidic amino acid; and position 194 is Trp, Tyr, His, or Phe. In some embodiments, the modified CH3 domain comprises Leu or Met at position 157; Leu, His, or Pro at position 159; Val at position 160; Trp or Gly at position 161; Val or Ala at position 162; Pro at position 186; Thr at position 189; and/or Trp at position 194.

In some embodiments, the modified CH3 domain comprises at least one position selected from the following: position 157 is Leu, Tyr, Met, or Val; position 159 is Leu, Thr, His, or Pro; position 160 is Val, Pro, or an acidic amino acid; position 161 is Trp; position 162 is Val, Ser, or Ala; position 186 is Glu, Ala, Ser, Leu, Thr, or Pro (e.g., Thr or Pro); position 189 is Thr or an acidic amino acid; and position 194 is Trp, Tyr, His, or Phe. In some embodiments, the modified CH3 domain comprises two, three, four, five, six, seven, or eight positions selected from the following: position 157 is Leu, Tyr, Met, or Val; position 159 is Leu, Thr, His, or Pro; position 160 is Val, Pro, or an acidic amino acid; position 161 is Trp; position 162 is Val, Ser, or Ala; position 186 is Glu, Ala, Ser, Leu, Thr, or Pro (e.g., Thr or Pro); position 189 is Thr or an acidic amino acid; and position 194 is Trp, Tyr, His, or Phe. In some embodiments, the modified CH3 domain comprises Leu or Met at position 157; Leu, His, or Pro at position 159; Val at position 160; Trp at position 161; Val or Ala at position 162; Pro at position 186; Thr at position 189; and/or Trp at position 194.

In some embodiments, the modified CH3 domain further comprises Ser, Thr, Gln, or Phe at position 164. In some embodiments, the modified CH3 domain further comprises Trp, Tyr, Leu, or Gln at position 153. In some embodiments, the modified CH3 domain further comprises Gln, Phe, or His at position 165. In some embodiments, the modified CH3 domain further comprises Trp at position 153 and/or Gln at position 165. In some embodiments, the modified CH3 domain further comprises Glu at position 188.

In some embodiments, the modified CH3 domain comprises Tyr at position 157; Thr at position 159; Glu or Val and position 160; Trp at position 161; Ser at position 162; Ser or Thr at position 186; Glu at position 189; and/or Phe at position 194. In some embodiments, the modified CH3 domain further comprises Trp, Tyr, Leu, or Gln at position 153. In some embodiments, the modified CH3 domain further comprises Glu at position 188. In some embodiments, the modified CH3 domain further comprises Trp at position 153 and/or Glu at position 188. In some embodiments, the modified CH3 domain further comprises Leu at position 153 and/or Glu at position 188. In some embodiments, the modified CH3 domain comprises Asn at position 163.

In some embodiments, the modified CH3 domain comprises one or more of the following substitutions: Trp at position 153; Thr at position 159; Trp at position 161; Val at position 162; Ser or Thr at position 186; Glu at position 188; and/or Phe at position 194.

In some embodiments, the modified CH3 domain further comprises one, two, or three positions selected from the following: position 187 is Lys, Arg, Gly, or Pro; position 197 is Ser, Thr, Glu, or Lys; and position 199 is Ser, Trp, or Gly.

In some embodiments, the modified CH3 domain has at least 85% identity, at least 90% identity, or at least 95% identity to amino acids 114-220 of any one of SEQ ID NOS:4-29, 236-299, and 422-435. In some embodiments, the modified CH3 domain has at least 85% identity to amino acids 114-220 of SEQ ID NO:1 with the proviso that the percent identity does not include the set of positions 157, 159, 160, 161, 162, 163, 186, 189, and 194. In some embodiments, the modified CH3 domain comprises amino acids 157-163 and/or 186-194 of any one of SEQ ID NOS:4-29, 236-299, and 422-435.

In some embodiments, the modified CH3 domain comprises at least one position selected from the following: position 153 is Trp, Leu, or Glu; position 157 is Tyr or Phe; position 159 is Thr; position 160 is Glu; position 161 is Trp; position 162 is Ser, Ala, Val, or Asn; position 163 is Ser or Asn; position 186 is Thr or Ser; position 188 is Glu or Ser; position 189 is Glu; and position 194 is Phe. In some embodiments, the modified CH3 domain comprises 2, 3, 4, 5, 6, 7, 8, 9, 10, or 11 positions (e.g., 11 positions) selected from the following: position 153 is Trp, Leu, or Glu (e.g., Trp or Leu); position 157 is Tyr or Phe; position 159 is Thr; position 160 is Glu; position 161 is Trp; position 162 is Ser, Ala, Val, or Asn; position 163 is Ser or Asn; position 186 is Thr or Ser; position 188 is Glu or Ser; position 189 is Glu; and position 194 is Phe. In some embodiments, the modified CH3 domain has at least 85% identity, at least 90% identity, or at least 95% identity to any one of SEQ ID NOS:236-299 and 422-435.

In some embodiments, the modified CH3 domain comprises the following amino acids: position 153 is Trp, Leu, or Glu (e.g., Trp or Leu); position 157 is Tyr or Phe; position 159 is Thr; position 160 is Glu; position 161 is Trp; position 162 is Ser, Ala, Val, or Asn; position 163 is Ser or Asn; position 186 is Thr or Ser; position 188 is Glu or Ser; position 189 is Glu; and position 194 is Phe. In a further embodiment, the modified CH3 domain has at least 85% identity, at least 90% identity, or at least 95% identity to any one of SEQ ID NOS:236-299 and 422-435.

In some embodiments, the modified CH3 domain comprises amino acids 153-163 and/or 186-194 of any one of SEQ ID NOS:236-299 and 422-435.

In some embodiments, provided herein is a polypeptide comprising a modified CH3 domain that specifically binds to a transferrin receptor, wherein the modified CH3 domain has at least 85% identity, at least 90% identity, or at least 95% identity to amino acids 114-220 of any one of SEQ ID NOS:4-29, 236-299, and 422-435. In certain embodiments, the residues of at least 5, 6, 7, 8, 9, 10, 11, 12, 13, 14, 15, or 16 (e.g., 11 to 16) of the positions corresponding to positions 153, 157, 159, 160, 161, 162, 163, 164, 165, 186, 187, 188, 189, 194, 197 and 199, determined with reference to SEQ ID NO:1, are not deleted or substituted in SEQ ID NOS:4-29 or 236-299.

In any of the above embodiments, the modified CH3 domain further comprises (i) a Trp at position 139 (T139W) or (ii) a Ser at position 139 (T139S), an Ala at position 141 (L141A), and a Val at position 180 (Y180V), wherein the amino acid positions are determined with reference to SEQ ID NO:1. In any of the above embodiments, the modified CH3 domain further comprises (i) a Leu at position 201 (M201L) and a Ser at position 207 (N207S), or (ii) a Ser or Ala at position 207 (N207S or N207A), wherein the amino acid positions are determined with reference to SEQ ID NO:1.

In another aspect, the disclosure features a polypeptide comprising a modified CH3 domain that specifically binds to a transferrin receptor, wherein the modified CH3 domain comprises one or more substitutions in a set of amino acid positions comprising 153, 157, 159, 160, 162, 163, 186, 188, 189, 194, 197, and 199; and wherein the substitutions and the positions are determined with reference to the sequence of SEQ ID NO:13. In some embodiments, the modified CH3 domain comprises Glu, Leu, Ser, Val, Trp, or Tyr at position 153; an aromatic amino acid, Met, Pro, or Val at position 157; Thr, Asn, or Val at position 159; Glu, Ile, Pro, or Val at position 160; an aliphatic amino acid, Ser, or Thr at position 162; Ser, Asn, Arg, or Thr at position 163; Thr, His, or Ser at position 186; Glu, Ser, Asp, Gly, Thr, Pro, Gln, or Arg at position 188; Glu or Arg at position 189; Phe, His, Lys, Tyr, or Trp at position 194; Ser, Thr, or Trp at position 197; and Ser, Cys, Pro, Met, or Trp at position 199. In particular embodiments, the aromatic amino acid at position 157 is Tyr, Phe, or Trp and the aliphatic amino acid at position 162 is Ala, Ile, or Val.

In some embodiments, the modified CH3 domain comprises Glu, Leu, or Trp at position 153; an aromatic amino acid at position 157; Thr at position 159; Glu at position 160; an aliphatic amino acid or Ser at position 162; Ser or Asn at position 163; Thr or Ser at position 186; Glu or Ser at position 188; Glu at position 189; Phe, His, Tyr, or Trp at position 194; Ser at position 197; and Ser at position 199. In particular embodiments, the aromatic amino acid at position 157 is Tyr or Phe and the aliphatic amino acid at position 162 is Ala or Val.

In some embodiments, the modified CH3 domain has the sequence of SEQ ID NO:556 or 559.

In some embodiments, the modified CH3 domain comprises one substitution in a set of amino acid positions comprising 153, 157, 159, 160, 162, 163, 186, 188, 189, 194, 197, and 199. In particular embodiments, the modified CH3 domain has the sequence of any one of SEQ ID NOS:563-574.

In some embodiments, the modified CH3 domain comprises Glu, Leu, or Trp at position 153; Tyr or Phe at position 157; Thr at position 159; Glu at position 160; Ala, Val, or Ser at position 162; Ser or Asn at position 163; Thr or Ser at position 186; Glu or Ser at position 188; Glu at position 189; Phe at position 194; Ser at position 197; and Ser at position 199. In particular embodiments, the modified CH3 domain has the sequence of SEQ ID NO:562.

In another aspect, the disclosure features a polypeptide comprising a modified CH3 domain that specifically binds to a transferrin receptor, wherein the modified CH3 domain comprises one or more substitutions in a set of amino acid positions comprising 153, 157, 159, 160, 162, 163, 164, 186, 189, and 194; and wherein the substitutions and the positions are determined with reference to the sequence of SEQ ID NO:9. In some embodiments, the modified CH3 domain comprises Glu or Trp at position 153; Val, Trp, Leu, or Tyr at position 157; Leu, Pro, Phe, Thr, or His at position 159;

Pro, Val, or Glu at position 160; Ala, Ser, Val, or Gly at position 162; Leu, His, Gln, Gly, Val, Ala, Asn, Asp, Thr, or Glu at position 163; Thr, Phe, Gln, Val, or Tyr at position 164; Leu, Ser, Glu, Ala, or Pro at position 186; Glu, Asp, Thr, or Asn at position 189; and Trp, Tyr, Phe, or His at position 194.

In some embodiments, the modified CH3 domain comprises Glu or Trp at position 153; Trp, Leu, or Tyr at position 157; Thr or His at position 159; Val at position 160; Ala, Ser, or Val at position 162; Val, Asn, or Thr at position 163; Gln or Tyr at position 164; Pro at position 186; Thr or Asn at position 189; and Trp, Tyr, Phe, or His at position 194. In particular embodiments, the modified CH3 domain has the sequence of SEQ ID NO:577 or 580.

In another aspect, polypeptides comprising a modified CH3 domain that specifically binds to a transferrin receptor, wherein the modified CH3 domain comprises four, five, six, seven, or eight substitutions in a set of amino acid positions comprising 118, 119, 120, 122, 210, 211, 212, and 213, and wherein the substitutions and the positions are determined with reference to amino acids 114-220 of SEQ ID NO:1, are provided. In some embodiments, the modified CH3 domain comprises Gly at position 210; Phe at position 211; and/or Asp at position 213. In some embodiments, the modified CH3 domain comprises at least one position selected from the following: position 118 is Phe or Ile; position 119 is Asp, Glu, Gly, Ala, or Lys; position 120 is Tyr, Met, Leu, Ile, or Asp; position 122 is Thr or Ala; position 210 is Gly; position 211 is Phe; position 212 is His, Tyr, Ser, or Phe; and position 213 is Asp. In some embodiments, the modified CH3 domain comprises two, three, four, five, six, seven, or eight positions selected from the following: position 118 is Phe or Ile; position 119 is Asp, Glu, Gly, Ala, or Lys; position 120 is Tyr, Met, Leu, Ile, or Asp; position 122 is Thr or Ala; position 210 is Gly; position 211 is Phe; position 212 is His, Tyr, Ser, or Phe; and position 213 is Asp. In some embodiments, the modified CH3 domain has at least 85% identity, at least 90% identity, or at least 95% identity to amino acids 114-220 of any one of SEQ ID NOS:30-46. In some embodiments, the modified CH3 domain has at least 85% identity to amino acids 114-220 of SEQ ID NO:1 with the proviso that the percent identity does not include the set of positions 118, 119, 120, 122, 210, 211, 212, and 213. In some embodiments, the modified CH3 domain comprises amino acids 118-122 and/or 210-213 of any one of SEQ ID NOS:30-46. In some embodiments, the modified CH3 domain further comprises (i) a Trp at position 139 (T139W) or (ii) a Ser at position 139 (T139S), an Ala at position 141 (L141A), and a Val at position 180 (Y180V), wherein the amino acid positions are determined with reference to SEQ ID NO:1. In some embodiments, the modified CH3 domain further comprises (i) a Leu at position 201 (M201L) and a Ser at position 207 (N207S), or (ii) a Ser or Ala at position 207 (N207S or N207A), wherein the amino acid positions are determined with reference to SEQ ID NO:1.

In some embodiments, the corresponding unmodified CH3 domain is a human IgG1, IgG2, IgG3, or IgG4 CH3 domain. In some embodiments, the polypeptide is joined to a CH2 domain (e.g., an IgG1, IgG2, IgG3, or IgG4 CH2 domain). In some embodiments, the CH2 domain contains one or both of the following sets of modifications with reference to the amino acid sequence of SEQ ID NO:1: (a) Ala at position 7 and at position 8 (L7A and L8A); and (b) Tyr at position 25 (M25Y), Thr at position 27 (S27T), and Glu at position 29 (T29E). In some embodiments, set (a) further comprises Gly at position 102 (P102G). In some embodiments, the polypeptide is further joined to a Fab via a hinge region. In some embodiments, the Fab binds to a Tau protein (e.g., a human Tau protein) or a fragment thereof. The Tau protein may be a phosphorylated Tau protein, an unphosphorylated Tau protein, a splice isoform of Tau protein, an N-terminal truncated Tau protein, a C-terminal truncated Tau protein, and/or a fragment thereof. In some embodiments, the Fab binds to a beta-secretase 1 (BACE1) protein (e.g., a human BACE1 protein) or a fragment thereof. The BACE1 protein may be a splice isoform of BACE1 protein or a fragment thereof. In some embodiments, the Fab binds to a triggering receptor expressed on myeloid cells 2 (TREM2) protein (e.g., a human TREM2 protein) or a fragment thereof. In some embodiments, the Fab binds to an alpha-synuclein protein (e.g., a human alpha-synuclein protein) or a fragment thereof. The alpha-synuclein protein may be a monomeric alpha-synuclein, an oligomeric alpha-synuclein, an alpha-synuclein fibril, a soluble alpha-synuclein, and/or a fragment thereof. In some embodiments, the polypeptide is a first polypeptide of a dimer such that the dimer is monovalent for transferrin receptor binding. In some embodiments, the polypeptide is a first polypeptide that forms a dimer with a second polypeptide that binds to the transferrin receptor and comprises a modified CH3 domain. In some embodiments, the modified CH3 domain of the second polypeptide is the same as the modified CH3 domain of the first polypeptide.

In another aspect, polypeptides comprising a modified CH2 domain that specifically binds to a transferrin receptor, wherein the modified CH2 domain comprises four, five, six, seven, eight, or nine substitutions at a set of amino acid positions comprising 47, 49, 56, 58, 59, 60, 61, 62, and 63, and wherein the substitutions and the positions are determined with reference to amino acids 4-113 of SEQ ID NO:1, are provided. In some embodiments, the modified CH2 domain comprises Glu at position 60 and/or Trp at position 61. In some embodiments, the modified CH2 domain comprises at least one position selected from the following: position 47 is Glu, Gly, Gln, Ser, Ala, Asn, Tyr, or Trp; position 49 is Ile, Val, Asp, Glu, Thr, Ala, or Tyr; position 56 is Asp, Pro, Met, Leu, Ala, Asn, or Phe; position 58 is Arg, Ser, Ala, or Gly; position 59 is Tyr, Trp, Arg, or Val; position 60 is Glu; position 61 is Trp or Tyr; position 62 is Gln, Tyr, His, Ile, Phe, Val, or Asp; and position 63 is Leu, Trp, Arg, Asn, Tyr, or Val. In some embodiments, the modified CH2 domain comprises at least two, three, four, five, six, seven, eight, or nine positions selected from following: position 47 is Glu, Gly, Gln, Ser, Ala, Asn, Tyr, or Trp; position 49 is Ile, Val, Asp, Glu, Thr, Ala, or Tyr; position 56 is Asp, Pro, Met, Leu, Ala, Asn, or Phe; position 58 is Arg, Ser, Ala, or Gly; position 59 is Tyr, Trp, Arg, or Val; position 60 is Glu; position 61 is Trp or Tyr; position 62 is Gln, Tyr, His, Ile, Phe, Val, or Asp; and position 63 is Leu, Trp, Arg, Asn, Tyr, or Val. In some embodiments, the modified CH2 domain comprises Glu, Gly, Gln, Ser, Ala, Asn, or Tyr at position 47; Ile, Val, Asp, Glu, Thr, Ala, or Tyr at position 49; Asp, Pro, Met, Leu, Ala, or Asn at position 56; Arg, Ser, or Ala at position 58; Tyr, Trp, Arg, or Val at position 59; Glu at position 60; Trp at position 61; Gln, Tyr, His, Ile, Phe, or Val at position 62; and/or Leu, Trp, Arg, Asn, or Tyr at position 63.

In some embodiments, the modified CH2 domain comprises Arg at position 58; Tyr or Trp at position 59; Glu at position 60; Trp at position 61; and/or Arg or Trp at position 63. In some embodiments, the modified CH2 domain has at least 85% identity, at least 90% identity, or at least 95% identity to amino acids 4-113 of any one of SEQ ID NOS:47-62. In some embodiments, the modified CH2 domain has at least 85% identity to amino acids 4-113 of SEQ ID NO:1 with the proviso that the percent identity does not include the set of positions 47, 49, 56, 58, 59, 60, 61, 62, and 63. In some embodiments, the modified CH2 domain comprises amino acids 47-49 and/or 56-63 of any one of SEQ ID NOS:47-62.

In another aspect, polypeptides comprising a modified CH2 domain that specifically binds to a transferrin receptor, wherein the modified CH2 domain comprises four, five, six, seven, eight, nine, or ten substitutions at a set of amino acid positions comprising 39, 40, 41, 42, 43, 44, 68, 70, 71, and 72, and wherein the substitutions and the positions are determined with reference to amino acids 4-113 of SEQ ID NO:1, are provided. In some embodiments, the modified CH2 domain comprises Pro at position 43, Glu at position 68, and/or Tyr at position 70. In some embodiments, the modified CH2 domain comprises at least one position selected from the following: position 39 is Pro, Phe, Ala, Met, or Asp; position 40 is Gln, Pro, Arg, Lys, Ala, Ile, Leu, Glu, Asp, or Tyr; position 41 is Thr, Ser, Gly, Met, Val, Phe, Trp, or Leu; position 42 is Pro, Val, Ala, Thr, or Asp; position 43 is Pro, Val, or Phe; position 44 is Trp, Gln, Thr, or Glu; position 68 is Glu, Val, Thr, Leu, or Trp; position 70 is Tyr, His, Val, or Asp; position 71 is Thr, His, Gln, Arg, Asn, or Val; and position 72 is Tyr, Asn, Asp, Ser, or Pro. In some embodiments, the modified CH2 domain comprises two, three, four, five, six, seven, eight, nine, or ten positions selected from the following: position 39 is Pro, Phe, Ala, Met, or Asp; position 40 is Gln, Pro, Arg, Lys, Ala, Ile, Leu, Glu, Asp, or Tyr; position 41 is Thr, Ser, Gly, Met, Val, Phe, Trp, or Leu; position 42 is Pro, Val, Ala, Thr, or Asp; position 43 is Pro, Val, or Phe; position 44 is Trp, Gln, Thr, or Glu; position 68 is Glu, Val, Thr, Leu, or Trp; position 70 is Tyr, His, Val, or Asp; position 71 is Thr, His, Gln, Arg, Asn, or Val; and position 72 is Tyr, Asn, Asp, Ser, or Pro.

In some embodiments, the modified CH2 domain comprises Pro, Phe, or Ala at position 39; Gln, Pro, Arg, Lys, Ala, or Ile at position 40; Thr, Ser, Gly, Met, Val, Phe, or Trp at position 41; Pro, Val, or Ala at position 42; Pro at position 43; Trp or Gln at position 44; Glu at position 68; Tyr at position 70; Thr, His, or Gln at position 71; and/or Tyr, Asn, Asp, or Ser at position 72. In some embodiments, the modified CH2 domain comprises Met at position 39; Leu or Glu at position 40; Trp at position 41; Pro at position 42; Val at position 43; Thr at position 44; Val or Thr at position 68; His at position 70; His, Arg, or Asn at position 71; and/or Pro at position 72. In some embodiments, the modified CH2 domain comprises Asp at position 39; Asp at position 40; Leu at position 41; Thr at position 42; Phe at position 43; Gln at position 44; Val or Leu at position 68; Val at position 70; Thr at position 71; and/or Pro at position 72.

In some embodiments, the modified CH2 domain has at least 85% identity, at least 90% identity, or at least 95% identity to amino acids 4-113 of any one of SEQ ID NOS:63-85. In some embodiments, the modified CH2 domain has at least 85% identity to amino acids 4-113 of SEQ ID NO:1 with the proviso that the percent identity does not include the set of positions 39, 40, 41, 42, 43, 44, 68, 70, 71, and 72. In some embodiments, the modified CH2 domain comprises amino acids 39-44 and/or 68-72 of any one of SEQ ID NOS:63-85.

In another aspect, polypeptides comprising a modified CH2 domain that specifically binds to a transferrin receptor, wherein the modified CH2 domain comprises four, five, six, seven, eight, nine, or ten substitutions at a set of amino acid positions comprising 41, 42, 43, 44, 45, 65, 66, 67, 69, and 73, and wherein the substitutions and the positions are determined with reference to amino acids 4-113 of SEQ ID NO:1, are provided. In some embodiments, the modified CH2 domain comprises at least one position selected from the following: position 41 is Val or Asp; position 42 is Pro, Met, or Asp; position 43 is Pro or Trp; position 44 is Arg, Trp, Glu, or Thr; position 45 is Met, Tyr, or Trp; position 65 is Leu or Trp; position 66 is Thr, Val, Ile, or Lys; position 67 is Ser, Lys, Ala, or Leu; position 69 is His, Leu, or Pro; and position 73 is Val or Trp. In some embodiments, the modified CH2 domain comprises two, three, four, five, six, seven, eight, nine, or ten positions selected from the following: position 41 is Val or Asp; position 42 is Pro, Met, or Asp; position 43 is Pro or Trp; position 44 is Arg, Trp, Glu, or Thr; position 45 is Met, Tyr, or Trp; position 65 is Leu or Trp; position 66 is Thr, Val, Ile, or Lys; position 67 is Ser, Lys, Ala, or Leu; position 69 is His, Leu, or Pro; and position 73 is Val or Trp.

In some embodiments, the modified CH2 domain comprises Val at position 41; Pro at position 42; Pro at position 43; Arg or Trp at position 44; Met at position 45; Leu at position 65; Thr at position 66; Ser at position 67; His at position 69; and/or Val at position 73. In some embodiments, the modified CH2 domain comprises Asp at position 41; Met or Asp at position 42; Trp at position 43; Glu or Thr at position 44; Tyr or Trp at position 45; Trp at position 65; Val, Ile, or Lys at position 66; Lys, Ala, or Leu at position 67; Leu or Pro at position 69; and/or Trp at position 73.

In some embodiments, the modified CH2 domain has at least 85% identity, at least 90% identity, or at least 95% identity to amino acids 4-113 of any one of SEQ ID NOS:86-90. In some embodiments, the modified CH2 domain has at least 85% identity to amino acids 4-113 of SEQ ID NO:1 with the proviso that the percent identity does not include the set of positions 41, 42, 43, 44, 45, 65, 66, 67, 69, and 73. In some embodiments, the modified CH2 domain comprises amino acids 41-45 and/or 65-73 of any one of SEQ ID NOS:86-90.

In another aspect, polypeptides comprising a modified CH2 domain that specifically binds to a transferrin receptor, wherein the modified CH2 domain comprises four, five, six, seven, eight, or nine substitutions at a set of amino acid positions comprising 45, 47, 49, 95, 97, 99, 102, 103, and 104, and wherein the substitutions and the positions are determined with reference to amino acids 4-113 of SEQ ID NO:1, are provided. In some embodiments, the modified CH2 domain comprises Trp at position 103. In some embodiments, the modified CH2 domain comprises at least one position selected from the following: position 45 is Trp, Val, Ile, or Ala; position 47 is Trp or Gly; position 49 is Tyr, Arg, or Glu; position 95 is Ser, Arg, or Gln; position 97 is Val, Ser, or Phe; position 99 is Ile, Ser, or Trp; position 102 is Trp, Thr, Ser, Arg, or Asp; position 103 is Trp; and position 104 is Ser, Lys, Arg, or Val. In some embodiments, the modified CH2 domain comprises two, three, four, five, six, seven, eight, or nine positions selected from the following: position 45 is Trp, Val, Ile, or Ala; position 47 is Trp or Gly; position 49 is Tyr, Arg, or Glu; position 95 is Ser, Arg, or Gln; position 97 is Val, Ser, or Phe; position 99 is Ile, Ser, or Trp; position 102 is Trp, Thr, Ser, Arg, or Asp; position 103 is Trp; and position 104 is Ser, Lys, Arg, or Val.

In some embodiments, the modified CH2 domain comprises Val or Ile at position 45; Gly at position 47; Arg at position 49; Arg at position 95; Ser at position 97; Ser at position 99; Thr, Ser, or Arg at position 102; Trp at position 103; and/or Lys or Arg at position 104.

In some embodiments, the modified CH2 domain has at least 85% identity, at least 90% identity, or at least 95% identity to amino acids 4-113 of any one of SEQ ID NOS:91-95. In some embodiments, the modified CH2 domain has at least 85% identity to amino acids 4-113 of SEQ ID NO:1 with the proviso that the percent identity does not include the set of positions 45, 47, 49, 95, 97, 99, 102, 103, and 104. In some embodiments, the modified CH2 domain comprises amino acids 45-49 and/or 95-104 of any one of SEQ ID NOS:91-95.

In some embodiments, the corresponding unmodified CH2 domain is a human IgG1, IgG2, IgG3, or IgG4 CH2 domain. In some embodiments, the modified CH2 domain contains one or both of the following sets of modifications with reference to the amino acid sequence of SEQ ID NO:1: (a) Ala at position 7 and at position 8 (L7A and L8A); and (b) Tyr at position 25 (M25Y), Thr at position 27 (S27T), and Glu at position 29 (T29E). In some embodiments, set (a) further comprises Gly at position 102 (P102G). In some embodiments, the polypeptide is joined to a CH3 domain. In some embodiments, the CH3 domain comprises (i) a Trp at position 139 (T139W) or (ii) a Ser at position 139 (T139S), an Ala at position 141 (L141A), and a Val at position 180 (Y180V), wherein the amino acid positions are determined with reference to the amino acid sequence of SEQ ID NO:1. In some embodiments, the CH3 domain comprises (i) a Leu at position 201 (M201L) and a Ser at position 207 (N207S), or (ii) a Ser or Ala at position 207 (N207S or N207A), wherein the amino acid positions are determined with reference to SEQ ID NO:1. In some embodiments, the polypeptide is further joined to a Fab. In some embodiments, the Fab binds to a Tau protein (e.g., a human Tau protein) or a fragment thereof. The Tau protein may be a phosphorylated Tau protein, an unphosphorylated Tau protein, a splice isoform of Tau protein, an N-terminal truncated Tau protein, a C-terminal truncated Tau protein, and/or a fragment thereof. In some embodiments, the Fab binds to a beta-secretase 1 (BACE1) protein (e.g., a human BACE1 protein) or a fragment thereof. The BACE1 protein may be a splice isoform of BACE1 protein or a fragment thereof. In some embodiments, the Fab binds to a triggering receptor expressed on myeloid cells 2 (TREM2) protein (e.g., a human TREM2 protein) or a fragment thereof. In some embodiments, the Fab binds to an alpha-synuclein protein (e.g., a human alpha-synuclein protein) or a fragment thereof. The alpha-synuclein protein may be a monomeric alpha-synuclein, an oligomeric alpha-synuclein, an alpha-synuclein fibril, a soluble alpha-synuclein, and/or a fragment thereof.

In some embodiments, the polypeptide comprises a modified CH2 domain or modified CH3 domain that competes for binding to a transferrin receptor with any one of the polypeptides described herein, e.g., any of SEQ ID NOS:4-95, 236-299, 302, and 347-553. In some embodiments, the polypeptide comprises a modified CH2 domain or modified CH3 domain that binds to the same epitope on a transferrin receptor as any one of the polypeptides described herein, e.g., any of SEQ ID NOS: 4-95, 236-299, 302, and 347-553.

In some embodiments, the polypeptide is a first polypeptide of a dimer such that the dimer is monovalent for transferrin receptor binding. In some embodiments, the polypeptide is a first polypeptide that forms a dimer with a second polypeptide that binds to the transferrin receptor and comprises a modified CH2 domain. In some embodiments, the modified CH2 domain of the second polypeptide is the same as the modified CH2 of the first polypeptide.

In another aspect, polypeptides that specifically bind to a transferrin receptor, comprising amino acids 157-194, or in some embodiments, amino acid 153-194 or amino acids 153-199, of any one of SEQ ID NOS:4-29, 236-299, and 422-435, amino acids 118-213 of any one of SEQ ID NOS:30-46, amino acids 47-63 of any one of SEQ ID NOS:47-62, amino acids 39-72 of any one of SEQ ID NOS:63-85, amino acids 41-73 of any one of SEQ ID NOS:86-90, or amino acids 45-104 of any one of SEQ ID NOS:91-95, are provided.

In another aspect, provided herein is a polypeptide having a knob mutation and at least 85% identity, at least 90% identity, or at least 95% identity to the sequence of any one of SEQ ID NOS:4-95, 236-299, and 422-435, wherein the knob mutation is T139W as numbered with reference to SEQ ID NO:1.

In some embodiments, the polypeptide comprises a knob mutation and a sequence having at least 85% identity, at least 90% identity, or at least 95% identity to the sequence of any one of SEQ ID NOS:349, 361, 373, 385, 397, 409, 436, 448, 460, and 472, wherein the knob mutation is T139W as numbered with reference to SEQ ID NO:1. In particular embodiments, the polypeptide comprises a sequence of any one of SEQ ID NOS:349, 361, 373, 385, 397, 409, 436, 448, 460, and 472.

In another aspect, provided herein is a polypeptide having a knob mutation, mutations that modulate effector function, and at least 85% identity, at least 90% identity, or at least 95% identity to the sequence of any one of SEQ ID NOS:4-95, 236-299, and 422-435, wherein the knob mutation is T139W and the mutations that modulate effector function are L7A, L8A, and/or P102G (e.g., L7A and L8A) as numbered with reference to SEQ ID NO:1.

In some embodiments, the polypeptide comprises a knob mutation, mutations that modulate effector function, and a sequence having at least 85% identity, at least 90% identity, or at least 95% identity to the sequence of any one of SEQ ID NOS:350, 362, 374, 386, 398, 410, 437, 449, 461, and 473, wherein the knob mutation is T139W and the mutations that modulate effector function are L7A and L8A as numbered with reference to SEQ ID NO:1. In particular embodiments, the polypeptide comprises a sequence of any one of SEQ ID NOS:350, 362, 374, 386, 398, 410, 437, 449, 461, and 473.

In some embodiments, the polypeptide comprises a knob mutation, mutations that modulate effector function, and a sequence having at least 85% identity, at least 90% identity, or at least 95% identity to the sequence of any one of SEQ ID NOS:351, 363, 375, 387, 399, 411, 438, 450, 462, and 474, wherein the knob mutation is T139W and the mutations that modulate effector function are L7A, L8A, and P102G as numbered with reference to SEQ ID NO:1. In particular embodiments, the polypeptide comprises a sequence of any one of SEQ ID NOS:351, 363, 375, 387, 399, 411, 438, 450, 462, and 474.

In another aspect, provided herein is a polypeptide having a knob mutation, mutations that increase serum stability, and at least 85% identity, at least 90% identity, or at least 95% identity to the sequence of any one of SEQ ID NOS:4-95, 236-299, and 422-435, wherein the knob mutation is T139W and the mutations that increase serum stability are (i) M25Y, S27T, and T29E as numbered with reference to SEQ ID NO:1, or (ii) N207S with or without M201L as numbered with reference to SEQ ID NO:1 as numbered with reference to SEQ ID NO:1.

In some embodiments, the polypeptide comprises a knob mutation, mutations that increase serum stability, and a sequence having at least 85% identity, at least 90% identity, or at least 95% identity to the sequence of any one of SEQ ID NOS:352, 364, 376, 388, 400, 412, 439, 451, 463, and 475, wherein the knob mutation is T139W and the mutations that increase serum stability are M25Y, S27T, and T29E as numbered with reference to SEQ ID NO:1. In particular embodiments, the polypeptide comprises a sequence of any one of SEQ ID NOS:352, 364, 376, 388, 400, and 412.

In some embodiments, the polypeptide comprises a knob mutation, mutations that increase serum stability, and a sequence having at least 85% identity, at least 90% identity, or at least 95% identity to the sequence of any one of SEQ ID NOS:485, 492, 499, 506, 513, 520, 527, 534, 541, and 548, wherein the knob mutation is T139W and the mutations that increase serum stability are N207S with or without M201L as numbered with reference to SEQ ID NO:1 as numbered with reference to SEQ ID NO:1. In particular embodiments, the polypeptide comprises a sequence of any one of SEQ ID NOS: 485, 492, 499, 506, 513, 520, 527, 534, 541, and 548.

In another aspect, provided herein is a polypeptide having a knob mutation, mutations that modulate effector function, mutations that increase serum stability, and at least 85% identity, at least 90% identity, or at least 95% identity to the sequence of any one of SEQ ID NOS:4-95, 236-299, and 422-435, wherein the knob mutation is T139W, the mutations that modulate effector function are L7A, L8A, and/or P102G (e.g., L7A and L8A), and the mutations that increase serum stability are (i) M25Y, S27T, and T29E as numbered with reference to SEQ ID NO:1, or (ii) N207S with or without M201L as numbered with reference to SEQ ID NO:1 as numbered with reference to SEQ ID NO:1.

In some embodiments, the polypeptide comprises a knob mutation, mutations that modulate effector function, mutations that increase serum stability, and a sequence having at least 85% identity, at least 90% identity, or at least 95% identity to the sequence of any one of SEQ ID NOS:353, 365, 377, 389, 401, 413, 440, 452, 464, and 476, wherein the knob mutation is T139W, the mutations that modulate effector function are L7A and L8A, and the mutations that increase serum stability are M25Y, S27T, and T29E as numbered with reference to SEQ ID NO:1. In particular embodiments, the polypeptide comprises a sequence of any one of SEQ ID NOS:353, 365, 377, 389, 401, 413, 440, 452, 464, and 476.

In some embodiments, the polypeptide comprises a knob mutation, mutations that modulate effector function, mutations that increase serum stability, and a sequence having at least 85% identity, at least 90% identity, or at least 95% identity to the sequence of any one of SEQ ID NOS:486, 493, 500, 507, 514, 521, 528, 535, 542, and 549, wherein the knob mutation is T139W, the mutations that modulate effector function are L7A and L8A, and the mutations that increase serum stability are N207S with or without M201L as numbered with reference to SEQ ID NO:1 as numbered with reference to SEQ ID NO:1. In particular embodiments, the polypeptide comprises a sequence of any one of SEQ ID NOS:486, 493, 500, 507, 514, 521, 528, 535, 542, and 549.

In some embodiments, the polypeptide comprises a knob mutation, mutations that modulate effector function, mutations that increase serum stability, and a sequence having at least 85% identity, at least 90% identity, or at least 95% identity to the sequence of any one of SEQ ID NOS:354, 366, 378, 390, 402, 414, 441, 453, 465, and 477, wherein the knob mutation is T139W, the mutations that modulate effector function are L7A, L8A, and P102G, and the mutations that increase serum stability are M25Y, S27T, and T29E as numbered with reference to SEQ ID NO:1. In particular embodiments, the polypeptide comprises a sequence of any one of SEQ ID NOS:354, 366, 378, 390, 402, 414, 441, 453, 465, and 477.

In some embodiments, the polypeptide comprises a knob mutation, mutations that modulate effector function, mutations that increase serum stability, and a sequence having at least 85% identity, at least 90% identity, or at least 95% identity to the sequence of any one of SEQ ID NOS:487, 494, 501, 508, 515, 522, 529, 536, 543, and 550, wherein the knob mutation is T139W, the mutations that modulate effector function are L7A, L8A, and P102G, and the mutations that increase serum stability are N207S with or without M201L as numbered with reference to SEQ ID NO:1 as numbered with reference to SEQ ID NO:1. In particular embodiments, the polypeptide comprises a sequence of any one of SEQ ID NOS:487, 494, 501, 508, 515, 522, 529, 536, 543, and 550.

In another aspect, provided herein is a polypeptide having hole mutations and at least 85% identity, at least 90% identity, or at least 95% identity to the sequence of any one of SEQ ID NOS:4-95, 236-299, and 422-435, wherein the hole mutations are T139S, L141A, and Y180V as numbered with reference to SEQ ID NO:1.

In some embodiments, the polypeptide comprises hole mutations and a sequence having at least 85% identity, at least 90% identity, or at least 95% identity to the sequence of any one of SEQ ID NOS:355, 367, 379, 391, 403, 415, 442, 454, 466, and 478, wherein the hole mutations are T139S, L141A, and Y180V as numbered with reference to SEQ ID NO:1. In particular embodiments, the polypeptide comprises a sequence of any one of SEQ ID NOS:355, 367, 379, 391, 403, 415, 442, 454, 466, and 478.

In another aspect, provided herein is a polypeptide having hole mutations, mutations that modulate effector function, and at least 85% identity, at least 90% identity, or at least 95% identity to the sequence of any one of SEQ ID NOS:4-95, 236-299, and 422-435, wherein the hole mutations are T139S, L141A, and Y180V and the mutations that modulate effector function are L7A, L8A, and/or P102G (e.g., L7A and L8A) as numbered with reference to SEQ ID NO:1.

In some embodiments, the polypeptide comprises hole mutations, mutations that modulate effector function, and a sequence having at least 85% identity, at least 90% identity, or at least 95% identity to the sequence of any one of SEQ ID NOS:356, 368, 380, 392, 404, 416, 443, 455, 467, and 479, wherein the hole mutations are T139S, L141A, and Y180V and the mutations that modulate effector function are L7A and L8A as numbered with reference to SEQ ID NO:1. In particular embodiments, the polypeptide comprises a sequence of any one of SEQ ID NOS:356, 368, 380, 392, 404, 416, 443, 455, 467, and 479.

In some embodiments, the polypeptide comprises hole mutations, mutations that modulate effector function, and a sequence having at least 85% identity, at least 90% identity, or at least 95% identity to the sequence of any one of SEQ ID NOS:357, 369, 381, 393, 405, 417, 444, 456, 468, and 480, wherein the hole mutations are T139S, L141A, and Y180V and the mutations that modulate effector function are L7A, L8A, and P102G as numbered with reference to SEQ ID NO:1. In particular embodiments, the polypeptide comprises a sequence of any one of SEQ ID NOS:357, 369, 381, 393, 405, 417, 444, 456, 468, and 480.

In another aspect, provided herein is a polypeptide having hole mutations, mutations that increase serum stability, and at least 85% identity, at least 90% identity, or at least 95% identity to the sequence of any one of SEQ ID NOS:4-95, 236-299, and 422-435, wherein the hole mutations are T139S, L141A, and Y180V and the mutations that increase serum stability are (i) M25Y, S27T, and T29E as numbered with reference to SEQ ID NO:1, or (ii) N207S with or without M201L as numbered with reference to SEQ ID NO:1 as numbered with reference to SEQ ID NO:1.

In some embodiments, the polypeptide comprises hole mutations, mutations that increase serum stability, and a sequence having at least 85% identity, at least 90% identity, or at least 95% identity to the sequence of any one of SEQ ID NOS:358, 370, 382, 394, 406, 418, 445, 457, 469, and 481, wherein the hole mutations are T139S, L141A, and Y180V and the mutations that increase serum stability are M25Y, S27T, and T29E as numbered with reference to SEQ ID NO:1. In particular embodiments, the polypeptide comprises a sequence of any one of SEQ ID NOS:358, 370, 382, 394, 406, 418, 445, 457, 469, and 481.

In some embodiments, the polypeptide comprises hole mutations, mutations that increase serum stability, and a sequence having at least 85% identity, at least 90% identity, or at least 95% identity to the sequence of any one of SEQ ID NOS:488, 495, 502, 509, 516, 523, 530, 537, 544, and 551, wherein the hole mutations are T139S, L141A, and Y180V and the mutations that increase serum stability are N207S with or without M201L as numbered with reference to SEQ ID NO:1 as numbered with reference to SEQ ID NO:1. In particular embodiments, the polypeptide comprises a sequence of any one of SEQ ID NOS:488, 495, 502, 509, 516, 523, 530, 537, 544, and 551.

In another aspect, provided herein is a polypeptide having hole mutations, mutations that modulate effector function, mutations that increase serum stability, and at least 85% identity, at least 90% identity, or at least 95% identity to the sequence of any one of SEQ ID NOS:4-95, 236-299, and 422-435, wherein the hole mutations are T139S, L141A, and Y180V, the mutations that modulate effector function are L7A, L8A, and/or P102G (e.g., L7A and L8A), and the mutations that increase serum stability are (i) M25Y, S27T, and T29E as numbered with reference to SEQ ID NO:1, or (ii) N207S with or without M201L as numbered with reference to SEQ ID NO:1 as numbered with reference to SEQ ID NO:1.

In some embodiments, the polypeptide comprises hole mutations, mutations that modulate effector function, mutations that increase serum stability, and a sequence having at least 85% identity, at least 90% identity, or at least 95% identity to the sequence of any one of SEQ ID NOS:359, 371, 383, 395, 407, 419, 446, 458, 470, and 482, wherein the hole mutations are T139S, L141A, and Y180V, the mutations that modulate effector function are L7A and L8A, and the mutations that increase serum stability are M25Y, S27T, and T29E as numbered with reference to 303-345 NO:1. In particular embodiments, the polypeptide comprises a sequence of any one of SEQ ID NOS:359, 371, 383, 395, 407, 419, 446, 458, 470, and 482.

In some embodiments, the polypeptide comprises hole mutations, mutations that modulate effector function, mutations that increase serum stability, and a sequence having at least 85% identity, at least 90% identity, or at least 95% identity to the sequence of any one of SEQ ID NOS:489, 496, 503, 510, 517, 524, 531, 538, 545, and 552, wherein the hole mutations are T139S, L141A, and Y180V, the mutations that modulate effector function are L7A and L8A, and the mutations that increase serum stability are N207S with or without M201L as numbered with reference to SEQ ID NO:1 as numbered with reference to SEQ ID NO:1. In particular embodiments, the polypeptide comprises a sequence of any one of SEQ ID NOS:489, 496, 503, 510, 517, 524, 531, 538, 545, and 552.

In some embodiments, the polypeptide comprises hole mutations, mutations that modulate effector function, mutations that increase serum stability, and a sequence having at least 85% identity, at least 90% identity, or at least 95% identity to the sequence of any one of SEQ ID NOS:360, 372, 384, 396, 408, 420, 447, 459, 471, and 483, wherein the hole mutations are T139S, L141A, and Y180V, the mutations that modulate effector function are L7A, L8A, and P102G, and the mutations that increase serum stability are M25Y, S27T, and T29E as numbered with reference to SEQ ID NO:1. In particular embodiments, the polypeptide comprises a sequence of any one of SEQ ID NOS:360, 372, 384, 396, 408, 420, 447, 459, 471, and 483.

In some embodiments, the polypeptide comprises hole mutations, mutations that modulate effector function, mutations that increase serum stability, and a sequence having at least 85% identity, at least 90% identity, or at least 95% identity to the sequence of any one of SEQ ID NOS:490, 497, 504, 511, 518, 525, 532, 539, 546, and 553, wherein the hole mutations are T139S, L141A, and Y180V, the mutations that modulate effector function are L7A, L8A, and P102G, and the mutations that increase serum stability are N207S with or without M201L as numbered with reference to SEQ ID NO:1 as numbered with reference to SEQ ID NO:1. In particular embodiments, the polypeptide comprises a sequence of any one of SEQ ID NOS:490, 497, 504, 511, 518, 525, 532, 539, 546, and 553.

In another aspect, polypeptides that specifically bind to a transferrin receptor, comprising a sequence of any one of SEQ ID NOS:116-233, 303-345, and 581-608, are provided.

In some embodiments, polypeptides that specifically bind to a transferrin receptor, comprising a first sequence of any one of SEQ ID NOS:116-130 and a second sequence independently selected from the group consisting of SEQ ID NOS:131-139, are provided. In some embodiments, the polypeptide comprises a first sequence of any one of SEQ ID NOS:121, 116, 122, 123, or 126-130 and a second sequence independently selected from the group consisting of SEQ ID NOS:136, 137, and 139. In some embodiments, the polypeptide comprises a first sequence of any one of SEQ ID NOS:120 or 124-126 and a second sequence independently selected from the group consisting of SEQ ID NOS:135, 138, and 139.

In some embodiments, the polypeptide comprises SEQ ID NO:116 and SEQ ID NO:131, SEQ ID NO:116 and SEQ ID NO:136, SEQ ID NO:117 and SEQ ID NO:132, SEQ ID NO:118 and SEQ ID NO:133, SEQ ID NO:119 and SEQ ID NO:134, SEQ ID NO:120 and SEQ ID NO:135, SEQ ID NO:121 and SEQ ID NO:136, SEQ ID NO:122 and SEQ ID NO:137, SEQ ID NO:123 and SEQ ID NO:136, SEQ ID NO:124 and SEQ ID NO:138, SEQ ID NO:125 and SEQ ID NO:135, SEQ ID NO:126 and SEQ ID NO:139, SEQ ID NO:127 and SEQ ID NO:136, SEQ ID NO:128 and SEQ ID NO:136, SEQ ID NO:129 and SEQ ID NO:136, or SEQ ID NO:130 and SEQ ID NO:136.

In some embodiments, polypeptides that specifically bind to a transferrin receptor, comprising a first sequence of any one of SEQ ID NOS:303-339 and a second sequence independently selected from the group consisting of SEQ ID NOS:136, 138, and 340-345, are provided. In some embodiments, the polypeptide comprises SEQ ID NO:303 and SEQ ID NO:340, SEQ ID NO:304 and SEQ ID NO:340, SEQ ID NO:305 and SEQ ID NO:340, SEQ ID NO:306 and SEQ ID NO:341, SEQ ID NO:307 and SEQ ID NO:340, SEQ ID NO:308 and SEQ ID NO:340, SEQ ID NO:309 and SEQ ID NO:340, SEQ ID NO:310 and SEQ ID NO:340, SEQ ID NO:311 and SEQ ID NO:340, SEQ ID NO:312 and SEQ ID NO:341, SEQ ID NO:313 and SEQ ID NO:340, SEQ ID NO:314 and SEQ ID NO:340, SEQ ID NO:315 and SEQ ID NO:340, SEQ ID NO:316 and SEQ ID NO:340, SEQ ID NO:317 and SEQ ID NO:340, SEQ ID NO:318 and SEQ ID NO:341, SEQ ID NO:319 and SEQ ID NO:340, SEQ ID NO:320 and SEQ ID NO:340, SEQ ID NO:321 and SEQ ID NO:340, SEQ ID NO:322 and SEQ ID NO:340, SEQ ID NO:323 and SEQ ID NO:340, SEQ ID NO:324 and SEQ ID NO:341, SEQ ID NO:325 and SEQ ID NO:340, SEQ ID NO:326 and SEQ ID NO:340, SEQ ID NO:327 and SEQ ID NO:340, SEQ ID NO:328 and SEQ ID NO:340, SEQ ID NO:329 and SEQ ID NO:340, SEQ ID NO:330 and SEQ ID NO:341, SEQ ID NO:331 and SEQ ID NO:340, SEQ ID NO:332 and SEQ ID NO:340, SEQ ID NO:306 and SEQ ID NO:340, SEQ ID NO:312 and SEQ ID NO:340, SEQ ID NO:324 and SEQ ID NO:138, SEQ ID NO:318 and SEQ ID NO:340, SEQ ID NO:324 and SEQ ID NO:340, SEQ ID NO:330 and SEQ ID NO:340, SEQ ID NO:318 and SEQ ID NO:138, SEQ ID NO:333 and SEQ ID NO:136, SEQ ID NO:334 and SEQ ID NO:136, SEQ ID NO:312 and SEQ ID NO:138, SEQ ID NO:333 and SEQ ID NO:342, SEQ ID NO:335 and SEQ ID NO:342, SEQ ID NO:336 and SEQ ID NO:342, SEQ ID NO:334 and SEQ ID NO:342, SEQ ID NO:330 and SEQ ID NO:138, SEQ ID NO:330 and SEQ ID NO:343, SEQ ID NO:330 and SEQ ID NO:345, SEQ ID NO:337 and SEQ ID NO:136, SEQ ID NO:338 and SEQ ID NO:136, SEQ ID NO:339 and SEQ ID NO:136, SEQ ID NO:330 and SEQ ID NO:344, SEQ ID NO:312 and SEQ ID NO:343, or SEQ ID NO:312 and SEQ ID NO:345.

In another aspect, the disclosure features a polypeptide that specifically binds to a transferrin receptor, comprising a first sequence of any one of SEQ ID NOS:581, 583, 585, 587, 589, 591, and 593, and a second sequence independently selected from the group consisting of SEQ ID NOS: 582, 884, 586, 588, 590, 592, and 594. In particular embodiments, the polypeptide comprises SEQ ID NO:581 and SEQ ID NO:582, SEQ ID NO:583 and SEQ ID NO:584, SEQ ID NO:585 and SEQ ID NO:586, SEQ ID NO:587 and SEQ ID NO:588, SEQ ID NO:589 and SEQ ID NO:590, SEQ ID NO:591 and SEQ ID NO:592, or SEQ ID NO:593 and SEQ ID NO:594.

In another aspect, the disclosure features a polypeptide that specifically binds to a transferrin receptor, comprising a first sequence of any one of SEQ ID NOS:554, 557, and 560 and a second sequence independently selected from the group consisting of SEQ ID NOS:555, 558, and 561. In particular embodiments, the polypeptide comprises SEQ ID NO:554 and SEQ ID NO:555, SEQ ID NO:557 and SEQ ID NO:558, or SEQ ID NO:560 and SEQ ID NO:561.

In another aspect, the disclosure features a polypeptide that specifically binds to a transferrin receptor, comprising a first sequence of any one of SEQ ID NOS:554, 557, and 560 and a second sequence independently selected from the group consisting of SEQ ID NOS:340-345, 582, 584, 586, 588, 590, 592, and 594. In particular embodiments, the polypeptide comprises SEQ ID NO:554 and SEQ ID NO:340, SEQ ID NO:554 and SEQ ID NO:341, SEQ ID NO:554 and SEQ ID NO:342, SEQ ID NO:554 and SEQ ID NO:343, SEQ ID NO:554 and SEQ ID NO:344, SEQ ID NO:554 and SEQ ID NO:345, SEQ ID NO:554 and SEQ ID NO:582, SEQ ID NO:554 and SEQ ID NO:584, SEQ ID NO:554 and SEQ ID NO:586, SEQ ID NO:554 and SEQ ID NO:588, SEQ ID NO:554 and SEQ ID NO:590, SEQ ID NO:554 and SEQ ID NO:592, SEQ ID NO:554 and SEQ ID NO:594, SEQ ID NO:557 and SEQ ID NO:340, SEQ ID NO:557 and SEQ ID NO:341, SEQ ID NO:557 and SEQ ID NO:342, SEQ ID NO:557 and SEQ ID NO:343, SEQ ID NO:557 and SEQ ID NO:344, SEQ ID NO:557 and SEQ ID NO:345, SEQ ID NO:557 and SEQ ID NO:582, SEQ ID NO:557 and SEQ ID NO:584, SEQ ID NO:557 and SEQ ID NO:586, SEQ ID NO:557 and SEQ ID NO:588, SEQ ID NO:557 and SEQ ID NO:590, SEQ ID NO:557 and SEQ ID NO:592, SEQ ID NO:557 and SEQ ID NO:594, SEQ ID NO:560 and SEQ ID NO:340, SEQ ID NO:560 and SEQ ID NO:341, SEQ ID NO:560 and SEQ ID NO:342, SEQ ID NO:560 and SEQ ID NO:343, SEQ ID NO:560 and SEQ ID NO:344, or SEQ ID NO:560 and SEQ ID NO:345, SEQ ID NO:560 and SEQ ID NO:582, SEQ ID NO:560 and SEQ ID NO:584, SEQ ID NO:560 and SEQ ID NO:586, SEQ ID NO:560 and SEQ ID NO:588, SEQ ID NO:560 and SEQ ID NO:590, SEQ ID NO:560 and SEQ ID NO:592, or SEQ ID NO:560 and SEQ ID NO:594.

In another aspect, the disclosure features a polypeptide that specifically binds to a transferrin receptor, comprising a first sequence of any one of SEQ ID NOS:303-339, 581, 583, 585, 587, 589, 591, and 593, and a second sequence independently selected from the group consisting of SEQ ID NOS:555, 558, and 561. In particular embodiments, the polypeptide comprises SEQ ID NO:303 and SEQ ID NO:555, SEQ ID NO:303 and SEQ ID NO:558, SEQ ID NO:303 and SEQ ID NO:561, SEQ ID NO:304 and SEQ ID NO:555, SEQ ID NO:304 and SEQ ID NO:558, SEQ ID NO:304 and SEQ ID NO:561, SEQ ID NO:305 and SEQ ID NO:555, SEQ ID NO:305 and SEQ ID NO:558, SEQ ID NO:305 and SEQ ID NO:561, SEQ ID NO:306 and SEQ ID NO:555, SEQ ID NO:306 and SEQ ID NO:558, SEQ ID NO:306 and SEQ ID NO:561, SEQ ID NO:307 and SEQ ID NO:555, SEQ ID NO:307 and SEQ ID NO:558, SEQ ID NO:307 and SEQ ID NO:561, SEQ ID NO:308 and SEQ ID NO:555, SEQ ID NO:308 and SEQ ID NO:558, SEQ ID NO:308 and SEQ ID NO:561, SEQ ID NO:309 and SEQ ID NO:555, SEQ ID NO:309 and SEQ ID NO:558, SEQ ID NO:309 and SEQ ID NO:561, SEQ ID NO:310 and SEQ ID NO:555, SEQ ID NO:310 and SEQ ID NO:558, SEQ ID NO:310 and SEQ ID NO:561, SEQ ID NO:311 and SEQ ID NO:555, SEQ ID NO:311 and SEQ ID NO:558, SEQ ID NO:311 and SEQ ID NO:561, SEQ ID NO:312 and SEQ ID NO:555, SEQ ID NO:312 and SEQ ID NO:558, SEQ ID NO:312 and SEQ ID NO:561, SEQ ID NO:313 and SEQ ID NO:555, SEQ ID NO:313 and SEQ ID NO:558, SEQ ID NO:313 and SEQ ID NO:561, SEQ ID NO:314 and SEQ ID NO:555, SEQ ID NO:314 and SEQ ID NO:558, SEQ ID NO:314 and SEQ ID NO:561, SEQ ID NO:315 and SEQ ID NO:555, SEQ ID NO:315 and SEQ ID NO:558, SEQ ID NO:315 and SEQ ID NO:561, SEQ ID NO:316 and SEQ ID NO:555, SEQ ID NO:316 and SEQ ID NO:558, SEQ ID NO:316 and SEQ ID NO:561, SEQ ID NO:317 and SEQ ID NO:555, SEQ ID NO:317 and SEQ ID NO:558, SEQ ID NO:317 and SEQ ID NO:561, SEQ ID NO:318 and SEQ ID NO:555, SEQ ID NO:318 and SEQ ID NO:558, SEQ ID NO:318 and SEQ ID NO:561, SEQ ID NO:319 and SEQ ID NO:555, SEQ ID NO:319 and SEQ ID NO:558, SEQ ID NO:319 and SEQ ID NO:561, SEQ ID NO:320 and SEQ ID NO:555, SEQ ID NO:320 and SEQ ID NO:558, SEQ ID NO:320 and SEQ ID NO:561, SEQ ID NO:321 and SEQ ID NO:555, SEQ ID NO:321 and SEQ ID NO:558, SEQ ID NO:321 and SEQ ID NO:561, SEQ ID NO:322 and SEQ ID NO:555, SEQ ID NO:322 and SEQ ID NO:558, SEQ ID NO:322 and SEQ ID NO:561, SEQ ID NO:323 and SEQ ID NO:555, SEQ ID NO:323 and SEQ ID NO:558, SEQ ID NO:323 and SEQ ID NO:561, SEQ ID NO:324 and SEQ ID NO:555, SEQ ID NO:324 and SEQ ID NO:558, SEQ ID NO:324 and SEQ ID NO:561, SEQ ID NO:325 and SEQ ID NO:555, SEQ ID NO:325 and SEQ ID NO:558, SEQ ID NO:325 and SEQ ID NO:561, SEQ ID NO:326 and SEQ ID NO:555, SEQ ID NO:326 and SEQ ID NO:558, SEQ ID NO:326 and SEQ ID NO:561, SEQ ID NO:327 and SEQ ID NO:555, SEQ ID NO:327 and SEQ ID NO:558, SEQ ID NO:327 and SEQ ID NO:561, SEQ ID NO:328 and SEQ ID NO:555, SEQ ID NO:328 and SEQ ID NO:558, SEQ ID NO:328 and SEQ ID NO:561, SEQ ID NO:329 and SEQ ID NO:555, SEQ ID NO:329 and SEQ ID NO:558, SEQ ID NO:329 and SEQ ID NO:561, SEQ ID NO:330 and SEQ ID NO:555, SEQ ID NO:330 and SEQ ID NO:558, SEQ ID NO:330 and SEQ ID NO:561, SEQ ID NO:331 and SEQ ID NO:555, SEQ ID NO:331 and SEQ ID NO:558, SEQ ID NO:331 and SEQ ID NO:561, SEQ ID NO:332 and SEQ ID NO:555, SEQ ID NO:332 and SEQ ID NO:558, SEQ ID NO:332 and SEQ ID NO:561, SEQ ID NO:333 and SEQ ID NO:555, SEQ ID NO:333 and SEQ ID NO:558, SEQ ID NO:333 and SEQ ID NO:561, SEQ ID NO:334 and SEQ ID NO:555, SEQ ID NO:334 and SEQ ID NO:558, SEQ ID NO:334 and SEQ ID NO:561, SEQ ID NO:335 and SEQ ID NO:555, SEQ ID NO:335 and SEQ ID NO:558, SEQ ID NO:335 and SEQ ID NO:561, SEQ ID NO:336 and SEQ ID NO:555, SEQ ID NO:336 and SEQ ID NO:558, SEQ ID NO:336 and SEQ ID NO:561, SEQ ID NO:337 and SEQ ID NO:555, SEQ ID NO:337 and SEQ ID NO:558, SEQ ID NO:337 and SEQ ID NO:561, SEQ ID NO:338 and SEQ ID NO:555, SEQ ID NO:338 and SEQ ID NO:558, SEQ ID NO:338 and SEQ ID NO:561, SEQ ID NO:339 and SEQ ID NO:555, SEQ ID NO:339 and SEQ ID NO:558, SEQ ID NO:339 and SEQ ID NO:561, SEQ ID NO:581 and SEQ ID NO:555, SEQ ID NO:581 and SEQ ID NO:558, SEQ ID NO:581 and SEQ ID NO:561, SEQ ID NO:583 and SEQ ID NO:555, SEQ ID NO:583 and SEQ ID NO:558, SEQ ID NO:583 and SEQ ID NO:561, SEQ ID NO:585 and SEQ ID NO:555, SEQ ID NO:585 and SEQ ID NO:558, SEQ ID NO:585 and SEQ ID NO:561, SEQ ID NO:587 and SEQ ID NO:555, SEQ ID NO:587 and SEQ ID NO:558, SEQ ID NO:587 and SEQ ID NO:561, SEQ ID NO:589 and SEQ ID NO:555, SEQ ID NO:589 and SEQ ID NO:558, SEQ ID NO:589 and SEQ ID NO:561, SEQ ID NO:591 and SEQ ID NO:555, SEQ ID NO:591 and SEQ ID NO:558, SEQ ID NO:591 and SEQ ID NO:561, SEQ ID NO:593 and SEQ ID NO:555, SEQ ID NO:593 and SEQ ID NO:558, or SEQ ID NO:593 and SEQ ID NO:561.

In another aspect, the disclosure features a polypeptide that specifically binds to a transferrin receptor, comprising a first sequence of any one of SEQ ID NOS:609-614 and a second sequence independently selected from the group consisting of SEQ ID NOS:615-620.

In another aspect, the disclosure features a polypeptide that specifically binds to a transferrin receptor, comprising a first sequence of any one of SEQ ID NOS:303, 312, 315-318, and 328 and a second sequence independently selected from the group consisting of SEQ ID NOS:135, 340, and 341. In particular embodiments, the polypeptide comprises SEQ ID NO:303 and SEQ ID NO:340, SEQ ID NO:316 and SEQ ID NO:340, SEQ ID NO:317 and SEQ ID NO:340, SEQ ID NO:318 and SEQ ID NO:340, SEQ ID NO:328 and SEQ ID NO:341, SEQ ID NO:318 and SEQ ID NO:340, SEQ ID NO:312 and SEQ ID NO:340, SEQ ID NO:303 and SEQ ID NO:341, SEQ ID NO:316 and SEQ ID NO:135, or SEQ ID NO:315 and SEQ ID NO:341.

In another aspect, the disclosure features a polypeptide that specifically binds to a transferrin receptor, comprising a first sequence of any one of SEQ ID NOS:595, 597, 599, 601, 603, 605, and 607 and a second sequence independently selected from the group consisting of SEQ ID NOS:596, 598, 600, 602, 604, 606, and 608. In particular embodiments, the polypeptide comprises SEQ ID NO:595 and SEQ ID NO:596, SEQ ID NO:597 and SEQ ID NO:598, SEQ ID NO:599 and SEQ ID NO:600, SEQ ID NO:601 and SEQ ID NO:602, SEQ ID NO:603 and SEQ ID NO:604, SEQ ID NO:605 and SEQ ID NO:606, or SEQ ID NO:607 and SEQ ID NO:608.

In another aspect, the disclosure features a polypeptide that specifically binds to a transferrin receptor, comprising a first sequence of any one of SEQ ID NOS:575 and 578 and a second sequence independently selected from the group consisting of SEQ ID NOS:576 and 579. In particular embodiments, the polypeptide comprises SEQ ID NO:575 and SEQ ID NO:576 or SEQ ID NO:578 and SEQ ID NO:579.

In another aspect, the disclosure features a polypeptide that specifically binds to a transferrin receptor, comprising a first sequence of any one of SEQ ID NOS:575 and 578 and a second sequence independently selected from the group consisting of SEQ ID NOS:136, 138, and 340-345.

In another aspect, the disclosure features a polypeptide that specifically binds to a transferrin receptor, comprising a first sequence of any one of SEQ ID NOS:303-339 and a second sequence independently selected from the group consisting of SEQ ID NOS:576 and 579.

In some embodiments, polypeptides that specifically bind to a transferrin receptor, comprising a first sequence of any one of SEQ ID NOS:140-153 and a second sequence independently selected from the group consisting of SEQ ID NOS:154-157, are provided. In some embodiments, the polypeptide comprises SEQ ID NO:140 and SEQ ID NO:154, SEQ ID NO:141 and SEQ ID NO:154, SEQ ID NO:142 and SEQ ID NO:154, SEQ ID NO:143 and SEQ ID NO:154, SEQ ID NO:144 and SEQ ID NO:154, SEQ ID NO:145 and SEQ ID NO:154, SEQ ID NO:146 and SEQ ID NO:154, SEQ ID NO:147 and SEQ ID NO:154, SEQ ID NO:148 and SEQ ID NO:155, SEQ ID NO:149 and SEQ ID NO:154, SEQ ID NO:140 and SEQ ID NO:156, SEQ ID NO:150 and SEQ ID NO:156, SEQ ID NO:151 and SEQ ID NO:157, SEQ ID NO:152 and SEQ ID NO:155, or SEQ ID NO:153 and SEQ ID NO:154.

In some embodiments, polypeptides that specifically bind to a transferrin receptor, comprising a first sequence of any one of SEQ ID NOS:158-171 and a second sequence independently selected from the group consisting of SEQ ID NOS:172-186, are provided. In some embodiments, the polypeptide comprises SEQ ID NO:158 and SEQ ID NO:172, SEQ ID NO:158 and SEQ ID NO:179, SEQ ID NO:159 and SEQ ID NO:173, SEQ ID NO:159, and SEQ ID NO:181, SEQ ID NO:160 and SEQ ID NO:174, SEQ ID NO:161 and SEQ ID NO:175, SEQ ID NO:162 and SEQ ID NO:176, SEQ ID NO:163 and SEQ ID NO:177, SEQ ID NO:164 and SEQ ID NO:178, SEQ ID NO:165 and SEQ ID NO:180, SEQ ID NO:166 and SEQ ID NO:182, SEQ ID NO:167 and SEQ ID NO:183, SEQ ID NO:168 and SEQ ID NO:184, SEQ ID NO:169 and SEQ ID NO:185, SEQ ID NO:170 and SEQ ID NO:174, or SEQ ID NO:171 and SEQ ID NO:186.

In some embodiments, polypeptides that specifically bind a transferrin receptor, comprising a first sequence of any one of SEQ ID NOS:187-204 and a second sequence independently selected from the group consisting of SEQ ID NOS: 205-215, are provided. In some embodiments, the polypeptide comprises SEQ ID NO:187 and SEQ ID NO:205, SEQ ID NO:187 and SEQ ID NO:206, SEQ ID NO:188 and SEQ ID NO:206, SEQ ID NO:189 and SEQ ID NO:207, SEQ ID NO:190 and SEQ ID NO:206, SEQ ID NO:191 and SEQ ID NO:205, SEQ ID NO:192 and SEQ ID NO:206, SEQ ID NO:193 and SEQ ID NO:208, SEQ ID NO:194 and SEQ ID NO:206, SEQ ID NO:195 and SEQ ID NO:209, SEQ ID NO:196 and SEQ ID NO:206, SEQ ID NO:197 and SEQ ID NO:205, SEQ ID NO:198 and SEQ ID NO:206, SEQ ID NO:199 and SEQ ID NO:208, SEQ ID NO:200 and SEQ ID NO:206, SEQ ID NO:201 and SEQ ID NO:210, SEQ ID NO:201 and SEQ ID NO:211, SEQ ID NO:201 and SEQ ID NO:212, SEQ ID NO:202 and SEQ ID NO:212, SEQ ID NO:203 and SEQ ID NO:213, SEQ ID NO:203 and SEQ ID NO:214, or SEQ ID NO:204 and SEQ ID NO:215.

In some embodiments, polypeptides that specifically bind to a transferrin receptor, comprising a first sequence of any one of SEQ ID NOS:216-220 and a second sequence independently selected from the group consisting of SEQ ID NOS:221-224, are provided. In some embodiments, the polypeptide comprises SEQ ID NO:216 and SEQ ID NO:221, SEQ ID NO:217 and SEQ ID NO:221, SEQ ID NO:218 and SEQ ID NO:222, SEQ ID NO:219 and SEQ ID NO:223, or SEQ ID NO:220 and SEQ ID NO:224.

In some embodiments, polypeptides that specifically bind to a transferrin receptor, comprising a first sequence of any one of SEQ ID NOS:225-228 and a second sequence independently selected from the group consisting of SEQ ID NOS:229-233, are provided. In some embodiments, the polypeptide comprises SEQ ID NO:225 and 229, SEQ ID NO:226 and SEQ ID NO:230, SEQ ID NO:226 and SEQ ID NO:231, SEQ ID NO:227 and SEQ ID NO:232, or SEQ ID NO:228 and SEQ ID NO:233.

In any of the above embodiments, the polypeptide may also comprise Leu-to-Ala substitutions at positions 7 and 8 (L7A and L8A). In some embodiments, the Ala substitutions at positions 7 and 8 (L7A and L8A) are in combination with a Pro-to-Gly substitution at position 102 (P102G).

In still another aspect, polynucleotides comprising a nucleic acid sequence encoding a polypeptide that specifically binds to a transferrin receptor as described herein are provided.

In another aspect, vectors comprising a polynucleotide comprising a nucleic acid sequence encoding a polypeptide that specifically binds to a transferrin receptor as described herein are provided.

In yet another aspect, host cells comprising a polynucleotide comprising a nucleic acid sequence encoding a polypeptide that specifically binds to a transferrin receptor as described herein are provided.

In still another aspect, methods for producing a polypeptide comprising a modified CH3 domain or a modified CH2 domain, the methods comprising culturing a host cell under conditions in which a polypeptide encoded by a polynucleotide described herein is expressed, are provided.

In another aspect, pharmaceutical compositions comprising a polypeptide that specifically binds to a transferrin receptor as described herein and a pharmaceutically acceptable carrier are provided.

In yet another aspect, methods for transcytosis of a composition across an endothelium, the methods comprising contacting the endothelium with a composition comprising a polypeptide that specifically binds to a transferrin receptor as described herein, are provided. In some embodiments, the endothelium is the blood-brain barrier (BBB).

In still another aspect, methods for engineering a CH3 domain to specifically bind to a transferrin receptor, the methods comprising:

(a) modifying a polynucleotide that encodes the CH3 domain to have at least five amino acid substitutions at a set of amino acid positions comprising:
(i) 157, 159, 160, 161, 162, 163, 186, 189, and 194; or
(ii) 118, 119, 120, 122, 210, 211, 212, and 213,
wherein the substitutions and positions are determined with reference to amino acids 114-220 of SEQ ID NO:1;

(b) expressing a polypeptide comprising the modified CH3 domain; and (c) determining whether the modified CH3 domain binds to the transferrin receptor, are provided.

In another aspect, provided herein is a method for engineering a CH3 domain to specifically bind to a transferrin receptor, the method comprising (a) modifying a polynucleotide that encodes the CH3 domain to have at least five amino acid substitutions in the CH3 domain as set forth in any one of the preceding paragraphs that describes CH3 domain substitutions; and (b) expressing and recovering a polypeptide comprising the modified CH3 domain.

In some embodiments, the steps of expressing the polypeptide comprising the modified CH3 domain and determining whether the modified CH3 domain binds to the transferrin receptor are performed using a display system. In some embodiments, the display system is a cell surface display system, a viral display system, an mRNA display system, a polysomal display system, or a ribosomal display system. In some embodiments, the polypeptide comprising the modified CH3 domain is expressed as a soluble protein.

In another aspect, methods for engineering a CH2 domain to specifically bind to a transferrin receptor, the methods comprising:

(a) modifying a polynucleotide that encodes the CH2 domain to have at least five amino acid substitutions at a set of amino acid positions comprising:

(i) 47, 49, 56, 58, 59, 60, 61, 62, and 63;

(ii) 39, 40, 41, 42, 43, 44, 68, 70, 71, and 72;

(iii) 41, 42, 43, 44, 45, 65, 66, 67, 69, and 73; or (iv) 45, 47, 49, 95, 97, 99, 102, 103, and 104;

wherein the substitutions and the positions are determined with reference to amino acids 4-113 of SEQ ID NO:1;

(b) expressing a polypeptide comprising the modified CH2 domain; and (c) determining whether the modified CH2 domain binds to the transferrin receptor, are provided.

In another aspect, provided herein is a method for engineering a CH2 domain to specifically bind to a transferrin receptor, the method comprising (a) modifying a polynucleotide that encodes the CH2 domain to have at least five amino acid substitutions in the CH2 domain as set forth in any one of the preceding paragraphs that describes CH2 domain substitutions; and (b) expressing and recovering a polypeptide comprising the modified CH2 domain.

In some embodiments, the steps of expressing the polypeptide comprising the modified CH2 domain and determining whether the modified CH2 domain binds to the transferrin receptor are performed using a display system. In some embodiments, the display system is a cell surface display system, a viral display system, an mRNA display system, a polysomal display system, or a ribosomal display system. In some embodiments, the polypeptide comprising the modified CH2 domain is expressed as a soluble protein.

In another aspect, the disclosure features a method for enhancing binding of a modified Fc polypeptide that comprises a non-native binding site to a target (e.g., a transferrin receptor), the method comprising: (a) introducing one or more substitutions at one or more positions within 10 Å (e.g., within 9 Å, 8 Å, 7 Å, 6 Å, 5 Å, 4 Å, 3 Å, 2 Å, or 1

Å) of the non-native binding site; and (b) testing the modified Fc polypeptide for binding the target.

In some embodiments, the non-native binding site comprises substitutions at one or more of the following positions: 157, 159, 160, 161, 162, 163, 186, 189, and 194.

In some embodiments, the one or more substitutions at one or more positions within 10 Å of the non-native binding site are selected from the group consisting of K21, R28, Q115, R117, E118, Q120, T132, K133, N134, Q135, S137, K143, E153, E155, S156, G158, Y164, K165, T166, D172, S173, D174, S176, K182, L183, T184, V185, K187, S188, Q191, Q192, G193, V195, F196, S197, S199, Q211, S213, S215, L216, S217, P218, G219, and K220, with reference to SEQ ID NO:1.

BRIEF DESCRIPTION OF THE DRAWINGS

FIG. 1A shows ELISA results for clone CH2A2.5. FIG. 1B shows ELISA results for clone CH2A2.1. FIG. 1C shows ELISA results for clone CH2A2.4. FIG. 1D shows ELISA results for CH2A2.16.

FIG. 2A shows results for the experiments where soluble holo-Tf was added. FIG. 2B shows results for the experiments where soluble TfR was added.

FIG. 3A shows the results of a phage ELISA where TfR was coated on an ELISA plate and clone CH2C.23, displayed on phage, was added in the presence or absence of a large excess of holo-Tf (5 µM). FIG. 3B shows CH2C clones, in Fc-Fab fusion format, binding to human or cyno TfR-coated ELISA plates. FIG. 3C shows the results of phage ELISAs where human TfR, cyno TfR, holo-Tf, anti-Myc, or streptavidin was coated on an ELISA plate and phage-displayed clones CH2C.17 and CH2C.22 were added at various dilutions, in the absence or presence of holo-Tf. These data show that these clones did not compete with holo-Tf for binding to TfR. FIG. 3D shows an Octet® (i.e., biolayer interferometry) kinetics trace for clone CH2C.7 binding to TfR-biotin coated on an anti-streptavidin sensor, in the presence of 5 µM holo-Tf and background subtracted for binding of holo-Tf alone, indicating no competition for binding with Tf.

FIG. 4A shows the results of a phage ELISA where human TfR, cyno TfR, holo-Tf, anti-Myc, or streptavidin was coated on an ELISA plate and phage-displayed clones CH3B.11 and CH3B.12 were added at various dilutions, in the absence or presence of holo-Tf. These data show that these clones did not compete with holo-Tf for binding to TfR. FIG. 4B shows CH3B clones binding to human or cyno TfR-coated ELISA plates. Fc regions comprising the CH3B clone sequences were fused to Fab fragments and were assayed in a dimer format.

FIG. 7A shows binding of CH3C variants to human TfR coated on ELISA plates. FIG. 7B shows binding of CH3C variants to human TfR coated on ELISA plates in the presence of 5 µM holo-Tf. FIG. 7C shows binding of CH3C variants to cyno TfR coated on ELISA plates.

FIG. 9A shows microscopy data. FIG. 9B shows a graph of the number of puncta per well.

FIG. 11A shows binding to human TfR. FIG. 11B shows binding to cyno TfR.

FIG. 12A shows binding of CH3C variants to human TfR coated on ELISA plates. FIG. 12B shows binding of CH3C variants to human TfR coated on ELISA plates in the presence of 5 µM holo-Tf.

FIG. 13 shows binding of CH3C clones identified from the first soft randomization library to 293F cells. Cells were distributed in 96-well V bottom plates, and varying concentrations of the CH3C clones, formatted as Fc-Fab fusion proteins, were added. After 1 hour incubation at 4° C., the plates were spun and washed, and then incubated with goat-anti-human-IgG-Alexa Fluor® 647 secondary antibody at 4° C. for 30 minutes. After additional washing of the cells, the plates were read on a FACSCanto™ II flow cytometer, and median fluorescence values in the APC (647 nm) channel were determined using FlowJo® software.

FIG. 14A shows CHO-K1 cells that overexpressed human TfR. FIG. 14B shows CHO-K1 cells that overexpressed cyno TfR. FIG. 14C shows CHO-K1 parental cells that did not express human TfR.

FIG. 15A shows the location of the apical domain on the human TfR protein. The inset shows a close-up view of the seven residues that differ between human and cyno TfR. FIG. 15B shows a sequence alignment containing the seven residues that differ between human (SEQ ID NO:107) and cyno (SEQ ID NO:108) TfR. The consensus sequence is SEQ ID NO:622.

FIGS. 16A-16E show binding of CH3C clones to the apical domain displayed on phage. FIG. 16A shows Myc expression of various TfR apical domain mutants, showing that the expression level of the mutants was similar and normalized. FIG. 16B shows CH3C.18 binding to wild-type and mutant human TfR apical domains, showing reduced binding to the R208G mutant. FIG. 16C shows CH3C.35 binding to wild-type and mutant human TfR apical domains, showing reduced binding to the R208G mutant. FIG. 16D shows CH3C.18 binding to wild-type human and cyno TfR apical domains and the G208R mutant cyno apical domain, showing recovery of binding to the mutant. FIG. 16E shows CH3C.35 binding to wild-type human and cyno TfR apical domains and the G208R mutant cyno apical domain, showing recovery of binding to the mutant.

FIG. 17A shows paratope mapping of CH3C.35 by ELISA binding to human TfR for reversion mutants. FIG. 17B shows paratope mapping of CH3C.35 by ELISA binding to cyno TfR for reversion mutants. FIG. 17C shows paratope mapping of CH3C.18 by ELISA binding to human TfR for reversion mutants. FIG. 17D shows paratope mapping of CH3C.18 by ELISA binding to cyno TfR for reversion mutants.

FIGS. 18A-18D show the design of CH3C consensus maturation libraries. FIG. 18A shows the consensus library based on the CH3C.35-like sequences. FIG. 18B shows the consensus library based on the CH3C.18-like sequences. FIG. 18C shows the gap libraries based on CH3C.18 and CH3C.35. FIG. 18D shows the aromatics library based on CH3C.18.

FIG. 19A shows data for CH3C.3.2-1. FIG. 19B shows data for CH3C.3.2-19. FIG. 19C shows data for CH3C.3.2-5. FIG. 19D shows data for CH3C.18. FIG. 19E shows data for CH3C.35.

FIG. 23A shows FACS data for clone CH3C.35.21. FIG. 23B shows FACS data for mutants wherein the 11 positions from clone CH3C.35.21 were mutated back to the wild-type (top row of FACS plots) or expressed as an NNK library of all 20 amino acids (bottom row of FACS plots, prior to any sorting).

FIG. 24A shows bivalent CH3C polypeptides binding to human TfR. FIG. 24B shows bivalent CH3C polypeptides binding to cyno TfR. FIG. 24C shows monovalent CH3C polypeptides binding to human TfR. FIG. 24D shows monovalent CH3C polypeptides binding to cyno TfR.

FIG. 25A shows 293F cells. FIG. 25B shows a zoom-in of the binding to 293F cells depicted in FIG. 25A. FIG. 25C shows CHO-K1 cells stably transfected with human TfR. FIG. 25D shows a zoom-in of the binding to CHO-K1 cells stably transfected with human TfR depicted in FIG. 25C. FIG. 25E shows CHO-K1 cells stably transfected with cyno TfR.

FIGS. 27A-27H show binding kinetics for CH3C polypeptides. FIG. 27A shows data for CH3C.35.N163 binding to human TfR. FIG. 27B shows data for CHC3.35 binding to human TfR. FIG. 27C shows data for CHC3.35.N163 monovalent binding to human TfR. FIG. 27D shows data for CHC3.35 monovalent binding to human TfR. FIG. 27E shows data for CH3C.35.N163 binding to cyno TfR. FIG. 27F shows data for CHC3.35 binding to cyno TfR. FIG. 27G shows data for CHC3.35.N163 monovalent binding to cyno TfR. FIG. 27H shows data for CHC3.35 monovalent binding to cyno TfR.

FIG. 28A shows data for CH3C.3.2-1 binding to human TfR. FIG. 28B shows data for CH3C.3.2-5 binding to human TfR. FIG. 28C shows data for CH3C.3.2-19 binding to human TfR. FIG. 28D shows data for CH3C.3.2-1 binding to cyno TfR. FIG. 28E shows data for CH3C.3.2-5 binding to cyno TfR. FIG. 28F shows data for CH3C.3.2-19 binding to cyno TfR.

FIGS. 29A-29E show binding of polypeptide-Fab fusions to FcRn at pH 5.5 in the presence (lower traces) or absence (upper traces) of the human TfR extracellular domain. FIG. 29A shows data for clone CH3C.35. FIG. 29B shows data for clone CH3C.35.19. FIG. 29C shows data for clone CH3C.35.20. FIG. 29D shows data for clone CH3C.35.21. FIG. 29E shows data for clone CH3C.35.24.

FIG. 32A shows the concentration of IgG in plasma. FIG. 32B shows the concentration of IgG in brain tissue.

FIGS. 33A and 33B show target engagement of polypeptides dosed in hTfR$^{apical+/+}$ mice after 24 hours, as measured by reductions in amyloid beta-protein 40 (Abeta 40). FIG. 33A shows Abeta 40 concentrations in plasma. FIG. 33B shows Abeta 40 concentrations in brain tissue.

FIG. 35A depicts the binding interface between clone CH3C.18 and the apical domain of the transferrin receptor. FIG. 35B shows a enlarged view of the binding interface depicted in FIG. 35A.

FIG. 36A depicts the structural architecture (top) of the TfR apical domain and the CH3C.18 Fc, and the binding surfaces (within 5 angstroms) (bottom) of the TfR apical domain and the CH3C.18 Fc. The co-complex structure was solved at 3.6 Å resolution. The structure reveals the epitope on the TfR apical domain bound to CH3C.18. In particular, the N-terminal region of the apical domain is involved in CH3C Fc binding, and the structure is consistent with CH3C.18 Fc and TfR apical domain mutagenesis data. Also, the CH3C.18 library side chains are all contacting the TfR (within 5 Å). CH3C.18 library residues: L157, H159, V160, W161, A162, V163, P186, T189, and W194. Non-library residues: F196 and S156. FIG. 36B depicts CH3C.18 Fc and TfR apical domain key interactions. A cation-pi interaction between W161 on the CH3C.18 Fc and R208 on the apical domain is a central binding interaction. Mutation of either CH3C.18 W388 or apical domain R208 disrupts CH3C.18 Fc and apical domain binding. Consistent with this, the R208G mutation from human to cyno explains the reduced cyno affinity. Furthermore, non-conserved residues in the human apical domain (N292 and E294 (K292 and D294 in cyno)) are nearby. Therefore, Q192 in CH3C.18 may be mutated to selectively improve cyno versus human binding.

FIG. 37A depicts hydrogen bonds and non-bonded contacts between residues in clone CH3C.18 (Chain A) and the apical domain of the transferrin receptor (Chain D). FIG. 37B depicts hydrogen bonds and non-bonded contacts between residues in clone CH3C.18 (Chain B) and the apical domain of the transferrin receptor (Chain C).

FIG. 38 shows an alignment of human IgG1, IgG2, IgG3, and IgG4 amino acid sequences (SEQ ID NOS:623-626).

FIG. 39A depicts the structural architecture (top) of the TfR apical domain and the CH3C.35 Fc, and the binding surfaces (within 5 A) (bottom) of the TfR apical domain and the CH3C.35 Fc. The co-complex structure was solved at 3.4 Å resolution. The structure reveals the epitope on the TfR apical domain bound to CH3C.35. The CH3C.35 library side chains are all contacting the TfR (within 5 A). CH3C.35 library residues: Y157, T159, E160, W161, S162, T186, E189, and W194. Non-library residues: F196, S156, Q192. FIGS. 39B and 39C show enlarged views of the binding interface between clone CH3C.35 and the apical domain of the transferrin receptor depicted in FIG. 39A.

FIG. 41A depicts hydrogen bonds and non-bonded contacts between residues in clone CH3C.35 (Chain A) and the apical domain of the transferrin receptor (Chain D). FIG. 41B depicts hydrogen bonds and non-bonded contacts between residues in clone CH3C.35 (Chain B) and the apical domain of the transferrin receptor (Chain C).

FIG. 42A shows that Ab210 and CH3C.35.9:Ab153 exhibited faster clearance due to TfR-mediated clearance compared to control IgG (Ab122) and Ab153. FIG. 42B shows that Ab153, Ab210, and CH3C.35.9:Ab153, which all bind to and inhibit BACE1, exhibited significant Aβ40 reduction in plasma.

FIG. 43A shows that animals dosed with Ab210 and CH3C.35.9:Ab153 showed about 70% reduction in CSF Aβ40 compared to Ab153 and control IgG (Ab122). FIG. 43B shows that animals dosed with Ab210 and CH3C.35.9:Ab153 showed about 75% reduction in sAPPβ/sAPPα ratio compared to Ab153 and control IgG (Ab122). n=4/group. Line graphs represent mean±SEM.

FIGS. 46A and 46B depict serum huIgG1 in serum and plasma Aβ concentration in plasma, showing peripheral exposure of dosed compounds and resulting effects on plasma Aβ levels over time. FIGS. 46C and 46D depict Aβ and sAPPβ/sAPPα in CSF of cynomolgus monkeys following dosing (mean±SEM, n=4-5 per group).

FIGS. 48A and 48B depict peripheral PK analysis (plasma huIgG1 concentrations (FIG. 48A) and clearance values (FIG. 48B)) of indicated proteins in hFcRn knock-in mice after a single 10 mg/kg intravenous injection over 14 days (mean±SEM, n=3 per group).

DETAILED DESCRIPTION OF THE INVENTION

I. Introduction

Figure 1A:
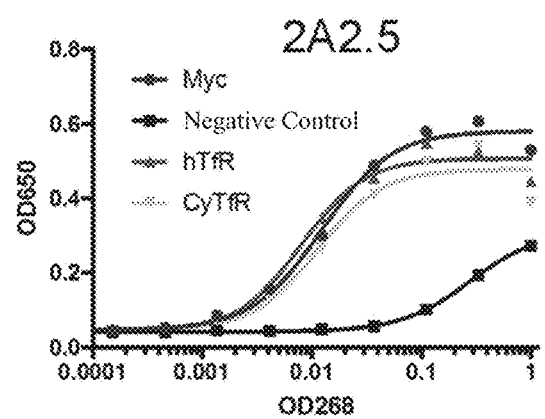
FIGS. 1A-1D show phage ELISA results for four CH2A2 clones. CH2A2 Fc variants were expressed on the surface of phage and tested for binding to anti-c-Myc antibody 9E10 (expression control), a negative control, human transferrin receptor (TfR), and cynomolgus (cyno) TfR coated on a plate. The x-axis shows $OD_{268}$ of phage solution, which is a measure of phage concentration.
Figure 1B:
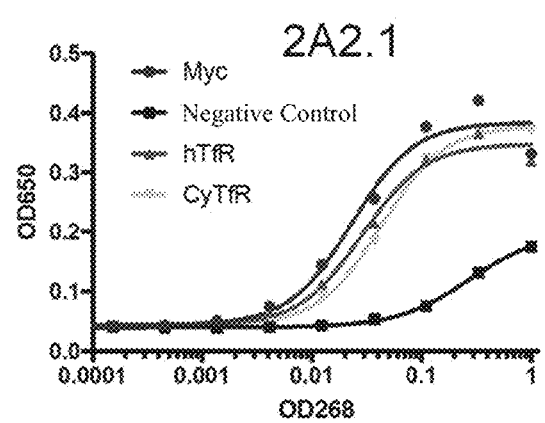
Figure 1C:
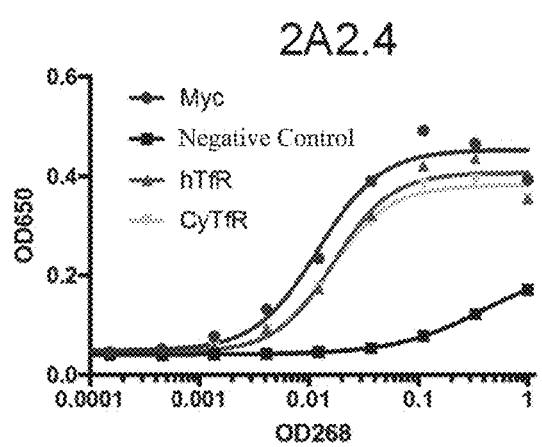
Figure 1D:
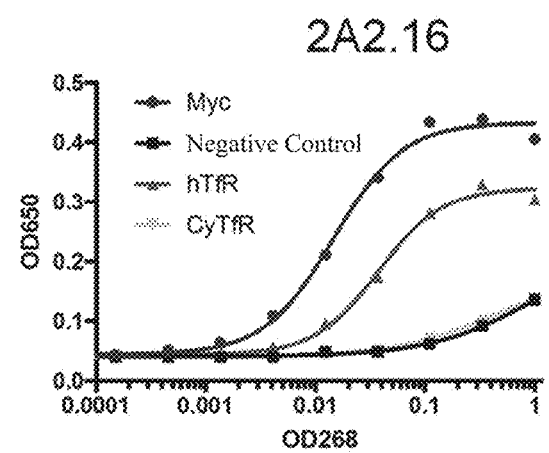

Described herein are polypeptides that bind a transferrin receptor (TfR). The invention is based, in part, on the discovery that certain amino acids in an Fc region can be modified to generate a novel binding site specific for TfR in the Fc polypeptide. Taking advantage of the fact that TfR is highly-expressed on the blood-brain barrier (BBB) and that TfR naturally moves transferrin from the blood into the brain, these polypeptides can be used to transport therapeutic agents (e.g., therapeutic polypeptides, antibody variable regions such as Fabs, and small molecules) across the BBB. This approach can substantially improve brain uptake of the therapeutic agents and is therefore highly useful for treating disorders and diseases where brain delivery is advantageous.

In one aspect, the invention is based, in part, on the discovery that certain sets of amino acids in a CH3 or CH2 domain polypeptide can be substituted to generate a polypeptide that binds a transferrin receptor. Thus, in one aspect, provided herein are transferrin receptor-binding polypeptides that have multiple substitutions at a set of amino acids (i) 157, 159, 160, 161, 162, 163, 186, 189, and 194; or (ii) 118, 119, 120, 122, 210, 211, 212, and 213 as numbered with reference to SEQ ID NO:1. In some embodiments, a transferrin receptor-binding polypeptide of the present invention has multiple substitutions at a set of amino acids (iii) 47, 49, 56, 58, 59, 60, 61, 62, and 63; (iv) 39, 40, 41, 42, 43, 44, 68, 70, 71, and 72; (v) 41, 42, 43, 44, 45, 65, 66, 67, 69, and 73; or (vi) 45, 47, 49, 95, 97, 99, 102, 103, and 104 as numbered with reference to SEQ ID NO:1. Anywhere from four to all of the amino acid positions of a set may be substituted. For purposes of this disclosure, a substitution is determined with reference to SEQ ID NO:1. Thus, an amino acid is considered to be a substitution if it differs from the corresponding amino acid in position SEQ ID NO:1 even if the amino acid is present at that position in a naturally occurring CH3 or CH2 domain polypeptide.

Also provided herein are methods of generating a transferrin receptor-binding polypeptide by generating variant polypeptides having substitutions at multiple positions of set (i), (ii), (iii), (iv), (v), or (vi). Such variants can be analyzed for transferrin receptor binding and further mutated to enhance binding as described herein.

In a further aspect, provided herein are treatment methods and methods of using a transferrin receptor-binding polypeptide to target a composition to transferrin receptor-expressing cells, e.g., to deliver the composition to that cell, or to deliver a composition across an endothelium such as the blood-brain barrier.

II. Definitions

As used herein, the singular forms "a," "an," and "the" include plural referents unless the content clearly dictates otherwise. Thus, for example, reference to "a polypeptide" may include two or more such molecules, and the like.

As used herein, the terms "about" and "approximately," when used to modify an amount specified in a numeric value or range, indicate that the numeric value as well as reasonable deviations from the value known to the skilled person in the art, for example ±20%, ±10%, or ±5%, are within the intended meaning of the recited value.

A "transferrin receptor" or "TfR" as used in the context of this invention refers to transferrin receptor protein 1. The human transferrin receptor 1 polypeptide sequence is set forth in SEQ ID NO:235. Transferrin receptor protein 1 sequences from other species are also known (e.g., chimpanzee, accession number XP_003310238.1; rhesus monkey, NP_001244232.1; dog, NP_001003111.1; cattle, NP_001193506.1; mouse, NP_035768.1; rat, NP_073203.1; and chicken, NP_990587.1). The term "transferrin receptor" also encompasses allelic variants of exemplary reference sequences, e.g., human sequences, that are encoded by a gene at a transferrin receptor protein 1 chromosomal locus. Full length transferrin receptor protein includes a short N-terminal intracellular region, a transmembrane region, and a large extracellular domain. The extracellular domain is characterized by three domains: a protease-like domain, a helical domain, and an apical domain. The apical domain sequence of human transferrin receptor 1 is set forth in SEQ ID NO:107.

The terms "CH3 domain" and "CH2 domain" as used herein refer to immunoglobulin constant region domain polypeptides. In the context of IgG antibodies, a CH3 domain polypeptide refers to the segment of amino acids from about position 341 to about position 447 as numbered according to the EU numbering scheme, and a CH2 domain polypeptide refers to the segment of amino acids from about position 231 to about position 340 as numbered according to the EU numbering scheme. CH2 and CH3 domain polypeptides may also be numbered by the IMGT (ImMunoGeneTics) numbering scheme in which the CH2 domain numbering is 1-110 and the CH3 domain numbering is 1-107, according to the IMGT Scientific chart numbering (IMGT website). CH2 and CH3 domains are part of the Fc region of an immunoglobulin. In the context of IgG antibodies, an Fc region refers to the segment of amino acids from about position 231 to about position 447 as numbered according to the EU numbering scheme. As used herein, the term "Fc region" may also include at least a part of a hinge region of an antibody. An illustrative hinge region sequence is set forth in SEQ ID NO:234.

The terms "wild-type," "native," and "naturally occurring" with respect to a CH3 or CH2 domain are used herein to refer to a domain that has a sequence that occurs in nature.

In the context of this invention, the term "mutant" with respect to a mutant polypeptide or mutant polynucleotide is used interchangeably with "variant." A variant with respect to a given wild-type CH3 or CH2 domain reference sequence can include naturally occurring allelic variants. A "non-naturally" occurring CH3 or CH2 domain refers to a variant or mutant domain that is not present in a cell in nature and that is produced by genetic modification, e.g., using genetic engineering technology or mutagenesis techniques, of a native CH3 domain or CH2 domain polynucleotide or polypeptide. A "variant" includes any domain comprising at least one amino acid mutation with respect to wild-type. Mutations may include substitutions, insertions, and deletions.

The term "amino acid" refers to naturally occurring and synthetic amino acids, as well as amino acid analogs and amino acid mimetics that function in a manner similar to the naturally occurring amino acids.

Naturally occurring amino acids are those encoded by the genetic code, as well as those amino acids that are later modified, e.g., hydroxyproline, γ-carboxyglutamate and O-phosphoserine. "Amino acid analogs" refers to compounds that have the same basic chemical structure as a naturally occurring amino acid, i.e., an α carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. "Amino acid mimetics" refers to chemical compounds that have a structure that is different from the general chemical structure of an amino acid, but that function in a manner similar to a naturally occurring amino acid.

Naturally occurring α-amino acids include, without limitation, alanine (Ala), cysteine (Cys), aspartic acid (Asp), glutamic acid (Glu), phenylalanine (Phe), glycine (Gly), histidine (His), isoleucine (Ile), arginine (Arg), lysine (Lys), leucine (Leu), methionine (Met), asparagine (Asn), proline (Pro), glutamine (Gln), serine (Ser), threonine (Thr), valine (Val), tryptophan (Trp), tyrosine (Tyr), and combinations thereof. Stereoisomers of a naturally occurring α-amino acids include, without limitation, D-alanine (D-Ala), D-cysteine (D-Cys), D-aspartic acid (D-Asp), D-glutamic acid (D-Glu), D-phenylalanine (D-Phe), D-histidine (D-His), D-isoleucine (D-Ile), D-arginine (D-Arg), D-lysine (D-Lys), D-leucine (D-Leu), D-methionine (D-Met), D-asparagine (D-Asn), D-proline (D-Pro), D-glutamine (D-Gln), D-serine (D-Ser), D-threonine (D-Thr), D-valine (D-Val), D-tryptophan (D-Trp), D-tyrosine (D-Tyr), and combinations thereof.

Amino acids may be referred to herein by either their commonly known three letter symbols or by the one-letter symbols recommended by the IUPAC-IUB Biochemical Nomenclature Commission.

The terms "polypeptide," "peptide," and "protein" are used interchangeably herein to refer to a polymer of amino acid residues. The terms apply to amino acid polymers in which one or more amino acid residue is an artificial chemical mimetic of a corresponding naturally occurring amino acid, as well as to naturally occurring amino acid polymers and non-naturally occurring amino acid polymers. Amino acid polymers may comprise entirely L-amino acids, entirely D-amino acids, or a mixture of L and D amino acids.

The term "conservative substitution," "conservative mutation," or "conservatively modified variant" refers to an alteration that results in the substitution of an amino acid with another amino acid that can be categorized as having a similar feature. Examples of categories of conservative amino acid groups defined in this manner can include: a "charged/polar group" including Glu (Glutamic acid or E), Asp (Aspartic acid or D), Asn (Asparagine or N), Gln (Glutamine or Q), Lys (Lysine or K), Arg (Arginine or R), and His (Histidine or H); an "aromatic group" including Phe (Phenylalanine or F), Tyr (Tyrosine or Y), Trp (Tryptophan or W), and (Histidine or H); and an "aliphatic group" including Gly (Glycine or G), Ala (Alanine or A), Val (Valine or V), Leu (Leucine or L), Ile (Isoleucine or I), Met (Methionine or M), Ser (Serine or S), Thr (Threonine or T), and Cys (Cysteine or C). Within each group, subgroups can also be identified. For example, the group of charged or polar amino acids can be sub-divided into sub-groups including: a "positively-charged sub-group" comprising Lys, Arg and His; a "negatively-charged sub-group" comprising Glu and Asp; and a "polar sub-group" comprising Asn and Gln. In another example, the aromatic or cyclic group can be sub-divided into sub-groups including: a "nitrogen ring sub-group" comprising Pro, His and Trp; and a "phenyl sub-group" comprising Phe and Tyr. In another further example, the aliphatic group can be sub-divided into sub-groups, e.g., an "aliphatic non-polar sub-group" comprising Val, Leu, Gly, and Ala; and an "aliphatic slightly-polar sub-group" comprising Met, Ser, Thr, and Cys. Examples of categories of conservative mutations include amino acid substitutions of amino acids within the subgroups above, such as, but not limited to: Lys for Arg or vice versa, such that a positive charge can be maintained; Glu for Asp or vice versa, such that a negative charge can be maintained; Ser for Thr or vice versa, such that a free —OH can be maintained; and Gln for Asn or vice versa, such that a free —NH$_2$ can be maintained. In some embodiments, hydrophobic amino acids are substituted for naturally occurring hydrophobic amino acid, e.g., in the active site, to preserve hydrophobicity.

The terms "identical" or percent "identity," in the context of two or more polypeptide sequences, refer to two or more sequences or subsequences that are the same or have a specified percentage of amino acid residues, e.g., at least 60% identity, at least 65%, at least 70%, at least 75%, at least 80%, at least 85%, at least 90%, or at least 95% or greater, that are identical over a specified region when compared and aligned for maximum correspondence over a comparison window, or designated region as measured using one a sequence comparison algorithm or by manual alignment and visual inspection.

For sequence comparison of polypeptides, typically one amino acid sequence acts as a reference sequence, to which a candidate sequence is compared. Alignment can be performed using various methods available to one of skill in the art, e.g., visual alignment or using publicly available software using known algorithms to achieve maximal alignment. Such programs include the BLAST programs, ALIGN, ALIGN-2 (Genentech, South San Francisco, Calif.) or Megalign (DNASTAR). The parameters employed for an alignment to achieve maximal alignment can be determined by one of skill in the art. For sequence comparison of polypeptide sequences for purposes of this application, the BLASTP algorithm standard protein BLAST for aligning two proteins sequence with the default parameters is used.

The terms "corresponding to," "determined with reference to," or "numbered with reference to" when used in the context of the identification of a given amino acid residue in a polypeptide sequence, refers to the position of the residue of a specified reference sequence when the given amino acid sequence is maximally aligned and compared to the reference sequence. Thus, for example, an amino acid residue in a polypeptide "corresponds to" an amino acid in the region of SEQ ID NO:1 from amino acids 114-220 when the residue aligns with the amino acid in SEQ ID NO:1 when optimally aligned to SEQ ID NO:1. The polypeptide that is aligned to the reference sequence need not be the same length as the reference sequence.

A "binding affinity" as used herein refers to the strength of the non-covalent interaction between two molecules, e.g., a single binding site on a polypeptide and a target, e.g., transferrin receptor, to which it binds. Thus, for example, the term may refer to 1:1 interactions between a polypeptide and its target, unless otherwise indicated or clear from context. Binding affinity may be quantified by measuring an equilibrium dissociation constant ($K_D$), which refers to the dissociation rate constant ($k_d$, time$^{-1}$) divided by the association rate constant ($k_a$, time$^{-1}$ M$^{-1}$). $K_D$ can be determined by measurement of the kinetics of complex formation and dissociation, e.g., using Surface Plasmon Resonance (SPR) methods, e.g., a Biacore™ system; kinetic exclusion assays such as KinExA®; and BioLayer interferometry (e.g., using the ForteBio® Octet® platform). As used herein, "binding affinity" includes not only formal binding affinities, such as those reflecting 1:1 interactions between a polypeptide and its target, but also apparent affinities for which $K_D$'s are calculated that may reflect avid binding.

The phrase "specifically binds" or "selectively binds" to a target, e.g., transferrin receptor, when referring to a polypeptide comprising a modified CH3 and/or modified CH2 domain as described herein, refers to a binding reaction whereby the polypeptide binds to the target with greater affinity, greater avidity, and/or greater duration than it binds to a structurally different target, e.g., a target not in the transferrin receptor family. In typical embodiments, the polypeptide has at least 5-fold, 6-fold, 7-fold, 8-fold, 9-fold, 10-fold, 20-fold, 25-fold, 50-fold, or 100-fold, or greater affinity for a transferrin receptor compared to an unrelated target when assayed under the same affinity assay conditions. In some embodiments, a modified CH3 and/or modified CH2 domain polypeptide specifically binds to an epitope on a transferrin receptor that is conserved among species, e.g., conserved between non-human primate and human species. In some embodiments, a polypeptide may bind exclusively to a human transferrin receptor.

The term "subject," "individual," and "patient," as used interchangeably herein, refer to a mammal, including but not limited to humans, non-human primates, rodents (e.g., rats, mice, and guinea pigs), rabbits, cows, pigs, horses, and other mammalian species. In one embodiment, the patient is a human.

The terms "treatment," "treating," and the like are used herein to generally mean obtaining a desired pharmacologic and/or physiologic effect. "Treating" or "treatment" may refer to any indicia of success in the treatment or amelioration of an injury, disease, or condition, including any objective or subjective parameter such as abatement, remission, improvement in patient survival, increase in survival time or rate, diminishing of symptoms or making the injury, disease, or condition more tolerable to the patient, slowing in the rate of degeneration or decline, or improving a patient's physical or mental well-being. The treatment or amelioration of symptoms can be based on objective or subjective parameters. The effect of treatment can be compared to an individual or pool of individuals not receiving the treatment, or to the same patient prior to treatment or at a different time during treatment.

The term "pharmaceutically acceptable excipient" refers to a non-active pharmaceutical ingredient that is biologically or pharmacologically compatible for use in humans or animals, such as but not limited to a buffer, carrier, or preservative.

As used herein, a "therapeutic amount" or "therapeutically effective amount" of an agent is an amount of the agent that treats, alleviates, abates, or reduces the severity of symptoms of a disease in a subject. A "therapeutic amount" or "therapeutically effective amount" of an agent may improve patient survival, increase survival time or rate, diminish symptoms, make an injury, disease, or condition more tolerable, slow the rate of degeneration or decline, or improve a patient's physical or mental well-being.

The term "administer" refers to a method of delivering agents, compounds, or compositions to the desired site of biological action. These methods include, but are not limited to, topical delivery, parenteral delivery, intravenous delivery, intradermal delivery, intramuscular delivery, intrathecal delivery, colonic delivery, rectal delivery, or intraperitoneal delivery. In one embodiment, the polypeptides described herein are administered intravenously.

III. Transferrin Receptor-Binding Polypeptides

This section describes generation of polypeptides in accordance with the invention that bind to a transferrin receptor and are capable of being transported across the blood-brain barrier (BBB).

In one aspect, polypeptides are provided that comprise CH3 or CH2 domains that have modifications that allow the polypeptides to specifically bind to a transferrin receptor. The modifications are introduced into specified sets of amino acids that are present at the surface of the CH3 or CH2 domain. In some embodiments, polypeptides comprising modified CH3 or CH2 domains specifically bind to an epitope in the apical domain of the transferrin receptor.

One of skill understands that CH2 and CH3 domains of other immunoglobulin isotypes, e.g., IgM, IgA, IgE, IgD, etc. may be similarly modified by identifying the amino acids in those domains that correspond to sets (i)-(vi) described herein. Modifications may also be made to corresponding domains from immunoglobulins from other species, e.g., non-human primates, monkey, mouse, rat, rabbit, dog, pig, chicken, and the like.

CH3 Transferrin Receptor-Binding Polypeptides

In some embodiments, the domain that is modified is a human Ig CH3 domain, such as an IgG CH3 domain. The CH3 domain can be of any IgG subtype, i.e., from IgG1, IgG2, IgG3, or IgG4. In the context of IgG antibodies, a CH3 domain refers to the segment of amino acids from about position 341 to about position 447 as numbered according to the EU numbering scheme. The positions in the CH3 domain for purposes of identifying the corresponding set of amino acid positions for transferrin receptor binding are determined with reference to SEQ ID NO:3 or determined with reference to amino acids 114-220 of SEQ ID NO:1 unless otherwise specified. Substitutions are also determined with reference to SEQ ID NO:1, i.e., an amino acid is considered to be a substitution relative to the amino acid at the corresponding position in SEQ ID NO:1. SEQ ID NO:1 includes a partial hinge region sequence, PCP, as amino acids 1-3. The numbering of the positions in the CH3 domain with reference to SEQ ID NO:1 includes the first three amino acids.

Figure 38:
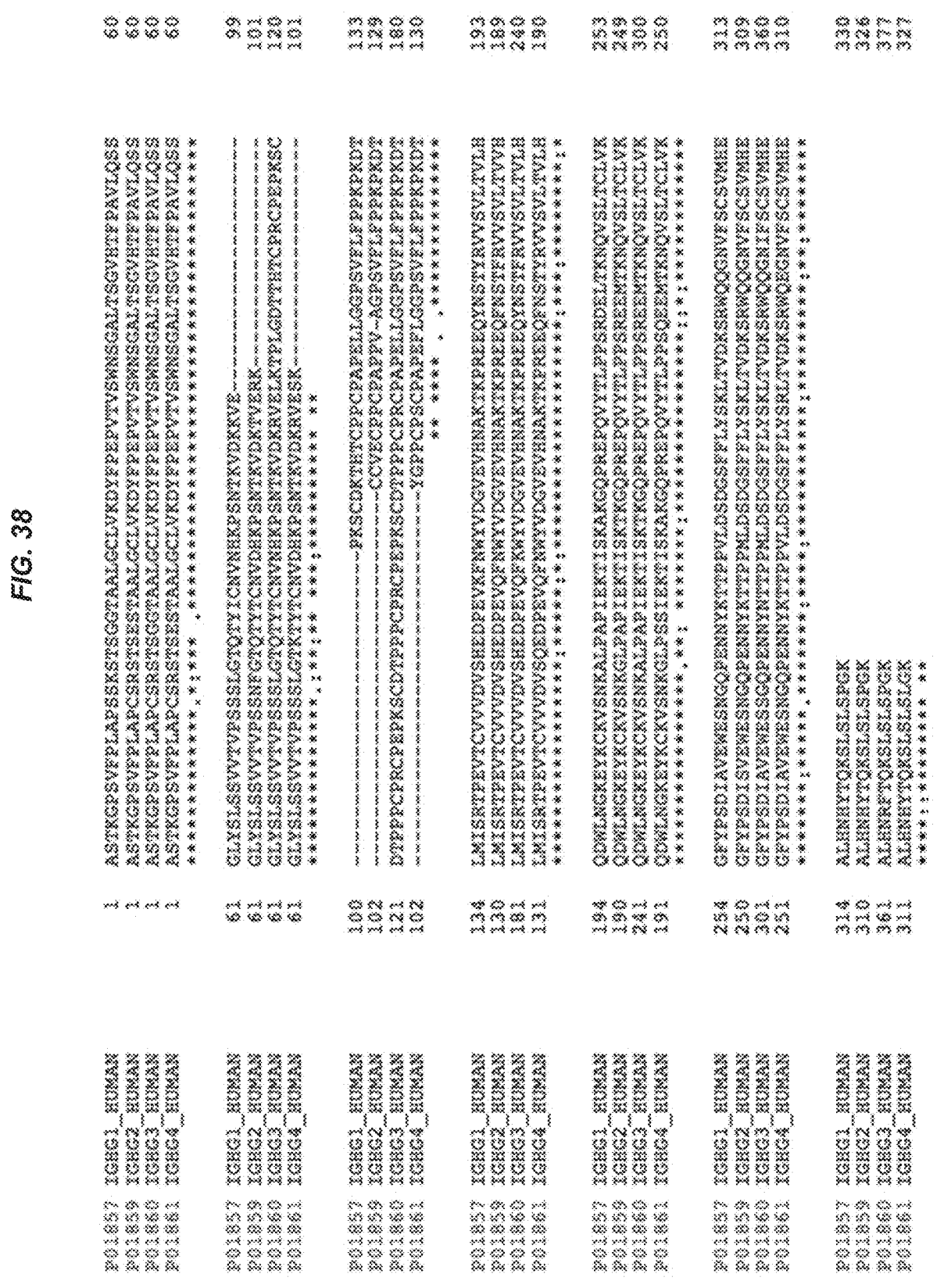

As indicated above, sets of residues of a CH3 domain that can be modified in accordance with the invention are numbered herein with reference to SEQ ID NO:1. Any CH3 domain, e.g., an IgG1, IgG2, IgG3, or IgG4 CH3 domain, may have modifications, e.g., amino acid substitutions, in one or more sets of residues that correspond to residues at the noted positions in SEQ ID NO:1. An alignment of the human IgG1 amino acid sequence of SEQ ID NO:1 with human IgG2, IgG3, and IgG4 is shown in FIG. 38. The positions of each of the IgG2, IgG3, and IgG4 sequences that correspond to any given position of SEQ ID NO:1 can be readily determined.

In one embodiment, a modified CH3 domain polypeptide that specifically binds transferrin receptor binds to the apical domain of the transferrin receptor at an epitope that comprises position 208 of the full length human transferrin receptor sequence (SEQ ID NO:235), which corresponds to position 11 of the human transferrin receptor apical domain sequence set forth in SEQ ID NO:107. SEQ ID NO:107 corresponds to amino acids 198-378 of the human transferrin receptor-1 uniprotein sequence P02786 (SEQ ID NO:235). In some embodiments, the modified CH3 domain polypeptide binds to the apical domain of the transferrin receptor at an epitope that comprises positions 158, 188, 199, 207, 208, 209, 210, 211, 212, 213, 214, 215, and/or 294 of the full length human transferrin receptor sequence (SEQ ID NO:235). The modified CH3 domain polypeptide may bind to the transferrin receptor without blocking or otherwise inhibiting binding of transferrin to the receptor. In some embodiments, binding of transferrin to TfR is not substantially inhibited. In some embodiments, binding of transferrin to TfR is inhibited by less than about 50% (e.g., less than about 45%, 40%, 35%, 30%, 25%, 20%, 15%, 10%, or 5%). In some embodiments, binding of transferrin to TfR is inhibited by less than about 20% (e.g., less than about 19%, 18%, 17%, 16%, 15%, 14%, 13%, 12%, 11%, 10%, 9%, 8%, 7%, 6%, 5%, 4%, 3%, 2%, or 1%). Illustrative CH3 domain polypeptides that exhibit this binding specificity include polypeptides having amino acid substitutions at positions 157, 159, 160, 161, 162, 163, 186, 189, and 194 as determined with reference to amino acids 114-220 of SEQ ID NO:1.

CH3 Transferrin Receptor Binding Set (i): 157, 159, 160, 161, 162, 163, 186, 189, and 194

In some embodiments, a modified CH3 domain polypeptide in accordance with the invention comprises at least three or at least four, and typically five, six, seven, eight, or nine substitutions in a set of amino acid positions comprising 157, 159, 160, 161, 162, 163, 186, 189, and 194 (set i). Illustrative substitutions that may be introduced at these positions are shown in Table 6. In some embodiments, the amino acid at position 161 and/or 194 is an aromatic amino acid, e.g., Trp, Phe, or Tyr. In some embodiments, the amino acid at position 161 is Trp. In some embodiments, the amino acid at position 161 is Gly. In some embodiments, the aromatic amino acid at position 194 is Trp or Phe.

In some embodiments, a modified CH3 domain polypeptide that specifically binds a transferrin receptor comprises at least one position having a substitution, relative to SEQ ID NO:1, as follows: Leu, Tyr, Met, or Val at position 157; Leu, Thr, His, or Pro at position 159; Val, Pro, or an acidic amino acid at position 160; an aromatic amino acid, e.g., Trp or Gly (e.g., Trp) at position 161; Val, Ser, or Ala at position 162; an acidic amino acid, Ala, Ser, Leu, Thr, or Pro at position 186; Thr or an acidic amino acid at position 189; or Trp, Tyr, His, or Phe at position 194. In some embodiments, a modified CH3 domain polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set. Thus, for example, Ile may be present at position 157, 159, and/or position 186. In some embodiments, the acidic amino acid at position one, two, or each of positions 160, 186, and 189 is Glu. In other embodiments, the acidic amino acid at one, two or each of positions 160, 186, and 189 is Asp. In some embodiments, two, three, four five, six, seven, or all eight of positions 157, 159, 160, 161, 162, 186, 189, and 194 have an amino acid substitution as specified in this paragraph.

In some embodiments, a CH3 domain polypeptide having modifications in set (i) comprises a native Asn at position 163. In some embodiments, the modified CH3 domain polypeptide comprises Gly, His, Gln, Leu, Lys, Val, Phe, Ser, Ala, or Asp at position 163. In some embodiments, the modified CH3 domain polypeptide further comprises one, two, three, or four substitutions at positions comprising 153, 164, 165, and 188. In some embodiments, Trp, Tyr, Leu, or Gln may be present at position 153. In some embodiments, Ser, Thr, Gln, or Phe may be present at position 164. In some embodiments, Gln, Phe, or His may be present at position 165. In some embodiments, Glu may be present at position 188.

In certain embodiments, the modified CH3 domain polypeptide comprises two, three, four, five, six, seven, eight nine, or ten positions selected from the following: Trp, Leu, or Glu at position 153; Tyr or Phe at position 157; Thr at position 159; Glu at position 160; Trp at position 161; Ser, Ala, Val, or Asn at position 162; Ser or Asn at position 163; Thr or Ser at position 186; Glu or Ser at position 188; Glu at position 189; and/or Phe at position 194. In some embodiments, the modified CH3 domain polypeptide comprises all eleven positions as follows: Trp, Leu, or Glu at position 153;

Tyr or Phe at position 157; Thr at position 159; Glu at position 160; Trp at position 161; Ser, Ala, Val, or Asn at position 162; Ser or Asn at position 163; Thr or Ser at position 186; Glu or Ser at position 188; Glu at position 189; and/or Phe at position 194.

In certain embodiments, the modified CH3 domain polypeptide comprises Leu or Met at position 157; Leu, His, or Pro at position 159; Val at position 160; Trp at position 161; Val or Ala at position 162; Pro at position 186; Thr at position 189; and/or Trp at position 194. In some embodiments, the modified CH3 domain polypeptide further comprises Ser, Thr, Gln, or Phe at position 164. In some embodiments, a modified CH3 domain polypeptide further comprises Trp, Tyr, Leu, or Gln at position 153 and/or Gln, Phe, or His at position 165. In some embodiments, Trp is present at position 153 and/or Gln is present at position 165. In some embodiments, a modified CH3 domain polypeptide does not have a Trp at position 153.

In other embodiments, a modified CH3 domain polypeptide comprises Tyr at position 157; Thr at position 159; Glu or Val and position 160; Trp at position 161; Ser at position 162; Ser or Thr at position 186; Glu at position 189; and/or Phe at position 194. In some embodiments, the modified CH3 domain polypeptide comprises a native Asn at position 163. In certain embodiments, the modified CH3 domain polypeptide further comprises Trp, Tyr, Leu, or Gln at position 153; and/or Glu at position 188. In some embodiments, the modified CH3 domain polypeptide further comprises Trp at position 153 and/or Glu at position 188.

In some embodiments, the modified CH3 domain comprises one or more of the following substitutions: Trp at position 153; Thr at position 159; Trp at position 161; Val at position 162; Ser or Thr at position 186; Glu at position 188; and/or Phe at position 194.

In additional embodiments, the modified CH3 domain further comprises one, two, or three positions selected from the following: position 187 is Lys, Arg, Gly, or Pro; position 197 is Ser, Thr, Glu, or Lys; and position 199 is Ser, Trp, or Gly.

In some embodiments, a modified CH3 domain polypeptide that specifically binds transferrin receptor has at least 70% identity, at least 75% identity, at least 80% identity, at least 85% identity, at least 90% identity, or at least 95% identity to amino acids 114-220 of any one of SEQ ID NOS:4-29, 236-299, and 422-435. In some embodiments, such a modified CH3 domain polypeptide comprises amino acids 157-163 and/or 186-194 of any one of SEQ ID NOS:4-29, 236-299, and 422-435. In some embodiments, such a modified CH3 domain polypeptide comprises amino acids 153-163 and/or 186-194 of any one of SEQ ID NOS:4-29, 236-299, and 422-435. In some embodiments, a modified CH3 domain polypeptide comprises amino acids 153-163 and/or 186-199 of any one of SEQ ID NOS:4-29, 236-299, and 422-435.

In some embodiments, a modified CH3 domain polypeptide that specifically binds transferrin receptor has at least 70% identity, at least 75% identity, at least 80% identity, at least 85% identity, at least 90% identity, or at least 95% identity to amino acids 114-220 of SEQ ID NO:1, with the proviso that the percent identity does not include the set of positions 157, 159, 160, 161, 162, 163, 186, 189, and 194. In some embodiments, the modified CH3 domain polypeptide comprises amino acids 157-163 and/or amino acids 186-194 as set forth in any one of SEQ ID NOS:4-29, 236-299, and 422-435.

In some embodiments, a modified CH3 domain polypeptide has at least 70% identity, at least 75% identity, at least 80% identity, at least 85% identity, at least 90% identity, or at least 95% identity to any one of SEQ ID NOS:4-29, 236-299, and 422-435, with the proviso that at least five, six, seven, eight, nine, ten, eleven, twelve, thirteen, fourteen, fifteen, or sixteen of the positions that correspond to positions 153, 157, 159, 160, 161, 162, 163, 164, 165, 186, 187, 188, 189, 194, 197, and 199 of any one of SEQ ID NOS:4-29, 236-299, and 422-435 are not deleted or substituted.

In some embodiments, the modified CH3 domain polypeptide has at least 75% identity, at least 80% identity, at least 85% identity, at least 90% identity, or at least 95% identity to any one of SEQ ID NOS:4-29, 236-299, and 422-435 and also comprises at at least five, six, seven, eight, nine, ten, eleven, twelve, thirteen, fourteen, fifteen or sixteen of the positions as follows: Trp, Tyr, Leu, Gln, or Glu at position 153; Leu, Tyr, Met, or Val at position 157; Leu, Thr, His, or Pro at position 159; Val, Pro, or an acidic amino acid at position 160; an aromatic amino acid, e.g., Trp, at position 161; Val, Ser, or Ala at position 162; Ser or Asn at position 163; Ser, Thr, Gln, or Phe at position 164; Gln, Phe, or His at position 165; an acidic amino acid, Ala, Ser, Leu, Thr, or Pro at position 186; Lys, Arg, Gly or Pro at position 187; Glu or Ser at position 188; Thr or an acidic amino acid at position 189; Trp, Tyr, His or Phe at position 194; Ser, Thr, Glu or Lys at position 197; and Ser, Trp, or Gly at position 199.

In some embodiments, a modified CH3 domain polypeptide in accordance with the invention comprises one or more substitutions in a set of amino acid positions comprising 153, 157, 159, 160, 162, 163, 186, 188, 189, 194, 197, and 199; and wherein the substitutions and the positions are determined with reference to the sequence of SEQ ID NO:13. In some embodiments, the modified CH3 domain comprises Glu, Leu, Ser, Val, Trp, or Tyr at position 153; an aromatic amino acid (e.g., Tyr, Phe, or Trp), Met, Pro, or Val at position 157; Thr, Asn, or Val at position 159; Glu, Ile, Pro, or Val at position 160; an aliphatic amino acid (e.g., Ala, Ile, or Val), Ser, or Thr at position 162; Ser, Asn, Arg, or Thr at position 163; Thr, His, or Ser at position 186; Glu, Ser, Asp, Gly, Thr, Pro, Gln, or Arg at position 188; Glu or Arg at position 189; Phe, His, Lys, Tyr, or Trp at position 194; Ser, Thr, or Trp at position 197; and Ser, Cys, Pro, Met, or Trp at position 199. A modified CH3 domain polypeptide may have the sequence: GQPREPQVYTLPPSRDELTKNQVSLTCLVKGFYPSDIAV$X_1$WES$X_2$G$X_3$$X_4$W$X_5$$X_6$YKT TPPVLDSDGSFFLYSKLTV$X_7$K$X_8$$X_9$WQQG$X_{10}$VF$X_{11}$C$X_{12}$VMHEALHNHYTQKSLSLS PGK (SEQ ID NO:556), in which $X_1$ is E, L, S, V, W, or Y; $X_2$ is an aromatic amino acid (e.g., Y, F, or W), M, P, or V; $X_3$ is T, N, or V; $X_4$ is E, I, P, or V; $X_5$ is an aliphatic amino acid (e.g., A, I, or V), S, or T; $X_6$ is S, N, R, or T; $X_7$ is T, H, or S; $X_8$ is E, S, D, G, T, P, Q, or R; $X_9$ is E or R; $X_{10}$ is F, H, K, Y, or W; $X_{11}$ is S, T, or W; and $X_{12}$ is S, C, P, M, or W. In certain embodiments, a modified CH3 domain polypeptide may comprise the sequence: $X_1$WES$X_2$G$X_3$$X_4$W$X_5$$X_6$ (SEQ ID NO:554), in which $X_1$ is E, L, S, V, W, or Y; $X_2$ is an aromatic amino acid (e.g., Y, F, or W), M, P, or V; $X_3$ is T, N, or V; $X_4$ is E, I, P, or V; $X_5$ is an aliphatic amino acid (e.g., A, I, or V), S, or T; and $X_6$ is S, N, R, or T. In certain embodiments, a modified CH3 domain polypeptide may comprise the sequence: $X_1$K$X_2$$X_3$WQQG$X_4$VF$X_5$C$X_6$ (SEQ ID NO:555), in which $X_1$ is T, H, or S; $X_2$ is E, S, D, G, T, P, Q, or R; $X_3$ is E or R; $X_4$ is F, H, K, Y, or W; $X_5$ is S, T, or W; and $X_6$ is S, C, P, M, or W.

In some embodiments, the modified CH3 domain polypeptide comprises Glu, Leu, or Trp at position 153; an aromatic amino acid at position 157; Thr at position 159;

Glu at position 160; an aliphatic amino acid or Ser at position 162; Ser or Asn at position 163; Thr or Ser at position 186; Glu or Ser at position 188; Glu at position 189; Phe, His, Tyr, or Trp at position 194; Ser at position 197; and Ser at position 199, wherein the substitutions and the positions are determined with reference to the sequence of SEQ ID NO:13. In particular embodiments, the aromatic amino acid at position 157 is Tyr or Phe and the aliphatic amino acid at position 162 is Ala or Val. A modified CH3 domain polypeptide may have the sequence of: GQPREPQVYTLPPSRDELTKNQVSLTCLVKGFYPS-DIAVX$_1$WESX$_2$GX$_3$X$_4$WX$_5$X$_6$YKT TPPVLDSDGSFFLYSKLTVX$_7$KX$_8$X$_9$WQQGX$_{10}$VFX$_{11}$-CX$_{12}$VMHEALHNHYTQKSLSLS PGK (SEQ ID NO:559), in which X$_1$ is E, L, or W; X$_2$ is an aromatic amino acid (e.g., Y or F); X$_3$ is T; X$_4$ is E; X$_5$ is an aliphatic amino acid (e.g., A or V) or S; X$_6$ is S or N; X$_7$ is T or S; X$_8$ is E or S; X$_9$ is E; X$_{10}$ is F, H, Y, or W; X$_{11}$ is S; and X$_{12}$ is S. In certain embodiments, a modified CH3 domain polypeptide may comprise the sequence: X$_1$WESX$_2$GX$_3$X$_4$WX$_5$X$_6$ (SEQ ID NO:557), in which X$_1$ is E, L, or W; X$_2$ is an aromatic amino acid (e.g., Y or F); X$_3$ is T; X$_4$ is E; X$_5$ is an aliphatic amino acid (e.g., A or V) or S; and X$_6$ is S or N. In certain embodiments, a modified CH3 domain polypeptide may comprise the sequence: X$_1$KX$_2$X$_3$WQQGX$_4$VFX$_5$CX$_6$ (SEQ ID NO:558), in which X$_1$ is T or S; X$_2$ is E or S; X$_3$ is E; X$_4$ is F, H, Y, or W; X$_5$ is S; and X$_6$ is S.

In further embodiments, the modified CH3 domain polypeptide may comprise Glu, Leu, or Trp at position 153; Tyr or Phe at position 157; Thr at position 159; Glu at position 160; Ala, Val, or Ser at position 162; Ser or Asn at position 163; Thr or Ser at position 186; Glu or Ser at position 188; Glu at position 189; Phe at position 194; Ser at position 197; and Ser at position 199, wherein the substitutions and the positions are determined with reference to the sequence of SEQ ID NO:13. A modified CH3 domain polypeptide may have the sequence: GQPREPQVYTL-PPSRDELTKNQVSLTCLVKGFYPSDIAVX$_1$WESX$_2$G-X$_3$X$_4$WX$_5$X$_6$YKT TPPVLDSDGSFFLY-SKLTVX$_7$KX$_8$X$_9$WQQGX$_{10}$VFX$_{11}$CX$_{12}$VMHEALHN-HYTQKSLSLS PGK (SEQ ID NO:562), in which X$_1$ is E, L, or W; X$_2$ is Y or F; X$_3$ is T; X$_4$ is E; X$_5$ is S, A or V; X$_6$ is S or N; X$_7$ is T or S; X$_8$ is E or S; X$_9$ is E; X$_{10}$ is F; X$_{11}$ is S; and X$_{12}$ is S. In certain embodiments, a modified CH3 domain polypeptide may comprise the sequence: X$_1$WESX$_2$GX$_3$X$_4$WX$_5$X$_6$ (SEQ ID NO:560), in which X$_1$ is E, L, or W; X$_2$ is Y or F; X$_3$ is T; X$_4$ is E; X$_5$ is S, A or V; and X$_6$ is S or N. In certain embodiments, a modified CH3 domain polypeptide may comprise the sequence: X$_1$KX$_2$X$_3$WQQGX$_4$VFX$_5$CX$_6$ (SEQ ID NO:561), in which X$_1$ is T or S; X$_2$ is E or S; X$_3$ is E; X$_4$ is F; X$_5$ is S; and X$_6$ is S.

In some embodiments, a modified CH3 domain polypeptide in accordance with the invention comprises only one substitution in a set of amino acid positions comprising 153, 157, 159, 160, 162, 163, 186, 188, 189, 194, 197, and 199; and wherein the substitutions and the positions are determined with reference to the sequence of SEQ ID NO:238. In some embodiments, the modified CH3 domain polypeptide comprises Glu, Leu, Ser, Val, Trp, or Tyr at position 153. The modified CH3 domain polypeptide may comprise Glu at position 153. The modified CH3 domain polypeptide may comprises Leu at position 153. The modified CH3 domain polypeptide may comprises Ser at position 153. The modified CH3 domain polypeptide may comprises Val at position 153. The modified CH3 domain polypeptide may Trp at position 153. The modified CH3 domain polypeptide may comprises Tyr at position 153. In some embodiments, the modified CH3 domain polypeptide comprises Tyr, Phe, Trp, Met, Pro, or Val at position 157. The modified CH3 domain polypeptide may comprise Tyr at position 157. The modified CH3 domain polypeptide may comprise Phe at position 157. The modified CH3 domain polypeptide may comprise Trp at position 157. The modified CH3 domain polypeptide may comprise Met at position 157. The modified CH3 domain polypeptide may comprise Pro at position 157. The modified CH3 domain polypeptide may comprise Val at position 157. In some embodiments, the modified CH3 domain polypeptide comprises Thr, Asn, or Val at position 159. The modified CH3 domain polypeptide may comprise Thr at position 159. The modified CH3 domain polypeptide may comprise Asn at position 159. The modified CH3 domain polypeptide may comprise Val at position 159. In some embodiments, the modified CH3 domain polypeptide comprises Glu, Ile, Pro, or Val at position 160. The modified CH3 domain polypeptide may comprise Glu at position 160. The modified CH3 domain polypeptide may comprise Ile at position 160. The modified CH3 domain polypeptide may comprise Pro at position 160. The modified CH3 domain polypeptide may comprise Val at position 160. In some embodiments, the modified CH3 domain polypeptide comprises Ala, Ile, Val, Ser, or Thr at position 162. The modified CH3 domain polypeptide may comprise Ala at position 162. The modified CH3 domain polypeptide may comprise Ile at position 162. The modified CH3 domain polypeptide may comprise Val at position 162. The modified CH3 domain polypeptide may comprise Ser at position 162. The modified CH3 domain polypeptide may comprise Thr at position 162. In some embodiments, the modified CH3 domain polypeptide comprises Ser, Asn, Arg, or Thr at position 163. The modified CH3 domain polypeptide may comprise Ser at position 163. The modified CH3 domain polypeptide may comprise Asn at position 163. The modified CH3 domain polypeptide may comprise Arg at position 163. The modified CH3 domain polypeptide may comprise Thr at position 163. In some embodiments, the modified CH3 domain polypeptide comprises Thr, His, or Ser at position 186. The modified CH3 domain polypeptide may comprise Thr at position 186. The modified CH3 domain polypeptide may comprise His at position 186. The modified CH3 domain polypeptide may comprise Ser at position 186. In some embodiments, the modified CH3 domain polypeptide comprises Glu, Ser, Asp, Gly, Thr, Pro, Gln, or Arg at position 188. The modified CH3 domain polypeptide may comprise Glu at position 188. The modified CH3 domain polypeptide may comprise Ser at position 188. The modified CH3 domain polypeptide may comprise Asp at position 188. The modified CH3 domain polypeptide may comprise Gly at position 188. The modified CH3 domain polypeptide may comprise Thr at position 188. The modified CH3 domain polypeptide may comprise Pro at position 188. The modified CH3 domain polypeptide may comprise Gln at position 188. The modified CH3 domain polypeptide may comprise Arg at position 188. In some embodiments, the modified CH3 domain polypeptide comprises Glu or Arg at position 189. The modified CH3 domain polypeptide may comprise Glu at position 189. The modified CH3 domain polypeptide may comprise Arg at position 189. In some embodiments, the modified CH3 domain polypeptide comprises Phe, His, Lys, Tyr, or Trp at position 194. The modified CH3 domain polypeptide may comprise Phe at position 194. The modified CH3 domain polypeptide may comprise His at position 194. The modified CH3 domain polypeptide may comprise Lys at position 194. The modified CH3 domain polypeptide may comprise Tyr at position 194. The modified CH3 domain polypeptide may comprise Trp at position 194. In some embodiments, the modified CH3 domain polypeptide comprises Ser, Thr, or Trp at position 197. The modified CH3 domain polypeptide may comprise Ser at position 197. The modified CH3 domain polypeptide may comprise Thr at position 197. The modified CH3 domain polypeptide may comprise Trp at position 197. In some embodiments, the modified CH3 domain polypeptide comprises Ser, Cys, Pro, Met, or Trp at position 199. The modified CH3 domain polypeptide may comprise Ser at position 199. The modified CH3 domain polypeptide may comprise Cys at position 199. The modified CH3 domain polypeptide may comprise Pro at position 199. The modified CH3 domain polypeptide may comprise Met at position 199. The modified CH3 domain polypeptide may comprise Trp at position 199. A modified CH3 domain polypeptide may have the sequence of any one of SEQ ID NOS:563-574.

In some embodiments, a modified CH3 domain polypeptide in accordance with the invention comprises one or more substitutions in a set of amino acid positions comprising 153, 157, 159, 160, 162, 163, 164, 186, 189, and 194; and wherein the substitutions and the positions are determined with reference to the sequence of SEQ ID NO:9. In some embodiments, the modified CH3 domain comprises Glu or Trp at position 153; Val, Trp, Leu, or Tyr at position 157; Leu, Pro, Phe, Thr, or His at position 159; Pro, Val, or Glu at position 160; Ala, Ser, Val, or Gly at position 162; Leu, His, Gln, Gly, Val, Ala, Asn, Asp, Thr, or Glu at position 163; Thr, Phe, Gln, Val, or Tyr at position 164; Leu, Ser, Glu, Ala, or Pro at position 186; Glu, Asp, Thr, or Asn at position 189; and Trp, Tyr, Phe, or His at position 194. A modified CH3 domain polypeptide may have the sequence: GQPREPQVYTLPPSRDELTKNQVSLTCLVKGFYP-SDIAVX$_1$WESX$_2$GX$_3$X$_4$WX$_5$X$_6$X$_7$KT TPPVLDSDGSFELYSKLTVX$_8$KSX$_9$WQQGX$_{10}$VFS-CSVMHEALHNHYTQKSLSLSPGK (SEQ ID NO:577), in which X$_1$ is E or W; X$_2$ is V, W, L, or Y; X$_3$ is L, P, F, T, or H; X$_4$ is P, V, or E; X$_5$ is A, S, V, or G; X$_6$ is L, H, Q, G, V, A N, D, T, or E; X$_7$ is T, F, Q, V, or Y; X$_8$ is L, S, E, A, or P; X$_9$ is E, D, T, or N; and X$_{10}$ is W, Y, H, or F. In certain embodiments, a modified CH3 domain polypeptide may comprise the sequence: X$_1$WESX$_2$GX$_3$X$_4$WX$_5$X$_6$X$_7$ (SEQ ID NO:575), in which X$_1$ is E or W; X$_2$ is V, W, L, or Y; X$_3$ is L, P, F, T, or H; X$_4$ is P, V, or E; X$_5$ is A, S, V, or G; X$_6$ is L, H, Q, G, V, A N, D, T, or E; and X$_7$ is T, F, Q, V, or Y. In certain embodiments, a modified CH3 domain polypeptide may comprise the sequence: X$_1$KSX$_2$WQQGX$_3$ (SEQ ID NO:576), in which X$_8$ is L, S, E, A, or P; X$_9$ is E, D, T, or N; and X$_{10}$ is W, Y, H, or F.

In some embodiments, the modified CH3 domain polypeptide comprises Glu or Trp at position 153; Trp, Leu, or Tyr at position 157; Thr or His at position 159; Val at position 160; Ala, Ser, or Val at position 162; Val, Asn, or Thr at position 163; Gln or Tyr at position 164; Pro at position 186; Thr or Asn at position 189; and Trp, Tyr, Phe, or His at position 194, wherein the substitutions and the positions are determined with reference to the sequence of SEQ ID NO:9. A modified CH3 domain polypeptide may have the sequence: GQPREPQVYTLPPSRD-ELTKNQVSLTCLVKGFYPSDIAVX$_1$WESX$_2$GX$_3$X$_4$W-X$_5$X$_6$X$_7$KT TPPVLDSDGSFELY-SKLTVX$_8$KSX$_9$WQQGX$_{10}$VFSCSVMHEALHNHYTQ-KSLSLSPGK (SEQ ID NO:580), in which X$_1$ is E or W; X$_2$ is W, L, or Y; X$_3$ is T or H; X$_4$ is V; X$_5$ is A, S, or V; X$_6$ is V, T, or N; X$_7$ is Y or Q; X$_8$ is P; X$_9$ is T or N; and X$_{10}$ is W, Y, H, or F. In certain embodiments, a modified CH3 domain polypeptide may comprise the sequence: X$_1$WESX$_2$GX$_3$X$_4$WX$_5$X$_6$X$_7$ (SEQ ID NO:578), in which X$_1$ is E or W; X$_2$ is W, L, or Y; X$_3$ is T or H; X$_4$ is V; X$_5$ is A, S, or V; X$_6$ is V, T, or N; and X$_7$ is Y or Q. In certain embodiments, a modified CH3 domain polypeptide may comprise the sequence: X$_1$KSX$_2$WQQGX$_3$ (SEQ ID NO:579), in which X$_1$ is P; X$_2$ is T or N; and X$_3$ is W, Y, H, or F.

In some embodiments, a transferrin receptor-binding polypeptide comprises the amino acid sequence of any one of SEQ ID NOS:116-130. In other embodiments, a transferrin receptor-binding polypeptide comprises the amino acid sequence of any one of SEQ ID NOS:116-130, but in which one or two amino acids are substituted. In some embodiments, the polypeptide comprises the amino acid sequence of any one of SEQ ID NOS:116-130, but in which three amino acids are substituted.

In some embodiments, a transferrin receptor-binding polypeptide comprises the amino acid sequence of any one of SEQ ID NOS:131-139. In other embodiments, a transferrin receptor-binding polypeptide comprises the amino acid sequence of any one of SEQ ID NOS:131-139, but in which one or two amino acids are substituted. In some embodiments, the polypeptide comprises the amino acid sequence of any one of SEQ ID NOS:131-139, but in which three or four amino acids are substituted.

In some embodiments, a transferrin receptor-binding polypeptide comprises the amino acid sequence of any one of SEQ ID NOS:303-339. In other embodiments, a transferrin receptor-binding polypeptide comprises the amino acid sequence of any one of SEQ ID NOS:303-339, but in which one or two amino acids are substituted. In some embodiments, the polypeptide comprises the amino acid sequence of any one of SEQ ID NOS:303-339, but in which three amino acids are substituted.

In some embodiments, a transferrin receptor-binding polypeptide comprises the amino acid sequence of any one of SEQ ID NOS:136, 138, and 340-345. In other embodiments, a transferrin receptor-binding polypeptide comprises the amino acid sequence of any one of SEQ ID NOS:136, 138, and 340-345, but in which one or two amino acids are substituted. In some embodiments, the polypeptide comprises the amino acid sequence of any one of SEQ ID NOS:136, 138, and 340-345, but in which three or four amino acids are substituted.

In additional embodiments, a transferrin receptor-binding polypeptide comprises amino acids 157-194, amino acids 153-194, or amino acids 153-199, of any one of SEQ ID NOS:4-29, 236-299, and 422-435. In further embodiments, the polypeptide comprises an amino acid sequence having at least 75% identity, at least 80% identity, at least 85% identity, at least 90% identity, or at least 95% identity to amino acids 157-194 of any one of SEQ ID NOS:4-29, 236-299, and 422-435, or to amino acids 153-194, or to amino acids 153-199, of any one of SEQ ID NOS:4-29, 236-299, and 422-435.

In some embodiments, the polypeptide comprises any one of SEQ ID NOS:4-29, 236-299, and 422-435. In further embodiments, the polypeptide comprises any one of SEQ ID NOS:4-29, 236-299, and 422-435 without the first three amino acids "PCP" at the amino-terminal end. In further embodiments, the polypeptide may have at least 75% identity, at least 80% identity, at least 85% identity, at least 90% identity, or at least 95% identity to any one of SEQ ID NOS:4-29, 236-299, and 422-435 as determined without the first three amino acids "PCP" at the amino-terminal end.

CH3 Transferrin Receptor Binding Set (ii): 118, 119, 120, 122, 210, 211, 212, and 213

In some embodiments, a modified CH3 domain polypeptide in accordance with the invention comprises at least three or at least four, and typically five, six, seven, or eight substitutions in a set of amino acid positions comprising 118, 119, 120, 122, 210, 211, 212, and 213 (set ii). Illustrative substitutions that may be introduced at these positions are shown in Table 5. In some embodiments, the modified CH3 domain polypeptide comprises Gly at position 210; Phe at position 211; and/or Asp at position 213. In some embodiments, Glu is present at position 213. In certain embodiments, a modified CH3 domain polypeptide comprises at least one substitution at a position as follows: Phe or Ile at position 118; Asp, Glu, Gly, Ala, or Lys at position 119; Tyr, Met, Leu, Ile, or Asp at position 120; Thr or Ala at position 122; Gly at position 210; Phe at position 211; His Tyr, Ser, or Phe at position 212; or Asp at position 213. In some embodiments, two, three, four, five, six, seven, or all eight of positions 118, 119, 120, 122, 210, 211, 212, and 213 have a substitution as specified in this paragraph. In some embodiments, a modified CH3 domain polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set.

In some embodiments, a modified CH3 domain polypeptide that specifically binds transferrin receptor has at least 70% identity, at least 75% identity, at least 80% identity, at least 85% identity, at least 90% identity, or at least 95% identity to amino acids 114-220 of any one of SEQ ID NOS:30-46. In some embodiments, such a modified CH3 domain polypeptide comprises amino acids 118-122 and/or amino acids 210-213 of any one of SEQ ID NOS:30-46.

In some embodiments, a modified CH3 domain polypeptide of the has at least 70% identity, at least 75% identity, at least 80% identity, at least 85% identity, at least 90% identity, or at least 95% identity to amino acids 114-220 of SEQ ID NO:1, with the proviso that the percent identity does not include the set of positions 118, 119, 120, 122, 210, 211, 212, and 213. In some embodiments, the modified CH3 domain polypeptide comprises amino acids 118-122 and/or amino acids 210-213 as set forth in any one of SEQ ID NOS:30-46.

In some embodiments, a transferrin receptor-binding polypeptide comprises the amino acid sequence of any one of SEQ ID NOS:140-153. In other embodiments, a transferrin receptor-binding polypeptide comprises the amino acid sequence of any one of SEQ ID NOS:140-153, but in which one or two amino acids are substituted.

In some embodiments, a transferrin receptor-binding polypeptide comprises the amino acid sequence of any one of SEQ ID NOS:154-157. In other embodiments, a transferrin receptor-binding polypeptide comprises the amino acid sequence of any one of SEQ ID NOS:154-157, but in which one amino acid is substituted or in which two amino acids are substituted.

In additional embodiments, a transferrin receptor-binding polypeptide comprises amino acids 118-213 of any one of SEQ ID NOS:30-46. In further embodiments, the polypeptide may comprise an amino acid sequence having at least 75% identity, at least 80% identity, at least 85% identity, at least 90% identity, or at least 95% identity to amino acids 118-213 of any one of SEQ ID NOS:30-46.

In some embodiments, the polypeptide comprises any one of SEQ ID NOS:30-46. In further embodiments, the polypeptide comprises any one of SEQ ID NOS:30-46 without the first three amino acids "PCP" at the amino-terminal end. In further embodiments, the polypeptide may have at least 75% identity, at least 80% identity, at least 85% identity, at least 90% identity, or at least 95% identity to any one of SEQ ID NOS:30-46 or to any one of SEQ ID NOS:30-46 as determined without the first three amino acids "PCP" at the amino-terminal end.

CH2 Transferrin Receptor-Binding Polypeptides

In some embodiments, the domain that is modified is a human Ig CH2 domain, such as an IgG CH2 domain. The CH2 domain can be of any IgG subtype, i.e., from IgG1, IgG2, IgG3, or IgG4. In the context of IgG antibodies, a CH2 domain refers to the segment of amino acids from about position 231 to about position 340 as numbered according to the EU numbering scheme. The positions in the CH2 domain for purposes of identifying the corresponding set of amino acid positions for transferrin receptor-binding are determined with reference to SEQ ID NO:2 or determined with reference to amino acids 4-113 of SEQ ID NO:1. Substitutions are also determined with reference to SEQ ID NO:1, i.e., an amino acid is considered to be a substitution relative to the amino acid at the corresponding position in SEQ ID NO:1. SEQ ID NO:1 includes a partial hinge region sequence, PCP, as amino acids 1-3. The three residues are not part of the Fc region; however, the numbering of the positions in the CH2 domain with reference to SEQ ID NO:1 includes the first three amino acids.

As indicated above, sets of residues of a CH2 domain that can be modified in accordance with the invention are numbered herein with reference to SEQ ID NO:1. Any CH2 domain, e.g., an IgG1, IgG2, IgG3, or IgG4 CH2 domain, may have modifications, e.g., amino acid substitutions, in one or more sets of residues that correspond to residues at the noted positions in SEQ ID NO:1. An alignment of the human IgG1 amino acid sequence of SEQ ID NO:1 with human IgG2, IgG3, and IgG4 is shown in FIG. 38. The positions of each of the IgG2, IgG3, and IgG4 sequences that correspond to any given position of SEQ ID NO:1 can be readily determined.

In one embodiment, a modified CH2 domain polypeptide that specifically binds transferrin receptor binds to an epitope in the apical domain of the transferrin receptor. The human transferrin receptor apical domain sequence is set forth in SEQ ID NO:107, which corresponds to amino acids 198-378 of the human transferrin receptor-1 uniprotein sequence P02786. The modified CH2 domain polypeptide may bind to the transferrin receptor without blocking or otherwise inhibiting binding of transferrin to the receptor. In some embodiments, binding of transferrin to TfR is not substantially inhibited. In some embodiments, binding of transferrin to TfR is inhibited by less than about 50% (e.g., less than about 45%, 40%, 35%, 30%, 25%, 20%, 15%, 10%, or 5%). In some embodiments, binding of transferrin to TfR is inhibited by less than about 20% (e.g., less than about 19%, 18%, 17%, 16%, 15%, 14%, 13%, 12%, 11%, 10%, 9%, 8%, 7%, 6%, 5%, 4%, 3%, 2%, or 1%).

CH2 transferrin receptor binding set (iii): 47, 49, 56, 58, 59, 60, 61, 62, and 63

In some embodiments, a modified CH2 domain polypeptide in accordance with the invention comprises at least three or at least four, and typically five, six, seven, eight, or nine substitutions in a set of amino acid positions comprising 47, 49, 56, 58, 59, 60, 61, 62, and 63 (set iii). Illustrative substitutions that may be introduced at these positions are shown in Table 1. In some embodiments, the modified CH2 domain polypeptide comprises Glu at position 60 and/or Trp at position 61. In some embodiments, the modified CH2 domain polypeptide comprises at least one substitution at a position as follows: Glu, Gly, Gln, Ser, Ala, Asn, Tyr, or Trp at position 47; Ile, Val, Asp, Glu, Thr, Ala, or Tyr at position 49; Asp, Pro, Met, Leu, Ala, Asn, or Phe at position 56; Arg, Ser, Ala, or Gly at position 58; Tyr, Trp, Arg, or Val at position 59; Glu at position 60; Trp or Tyr at position 61; Gln, Tyr, His, Ile, Phe, Val, or Asp at position 62; or Leu, Trp, Arg, Asn, Tyr, or Val at position 63. In some embodiments, two, three, four, five, six, seven, eight, or all nine of positions 47, 49, 56, 58, 59, 60, 61, 62, and 63 have a substitution as specified in this paragraph. In some embodiments, a modified CH2 domain polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set.

In some embodiments, a modified CH2 domain polypeptide comprises Glu, Gly, Gln, Ser, Ala, Asn, or Tyr at position 47; Ile, Val, Asp, Glu, Thr, Ala, or Tyr at position 49; Asp, Pro, Met, Leu, Ala, or Asn at position 56; Arg, Ser, or Ala at position 58; Tyr, Trp, Arg, or Val at position 59; Glu at position 60; Trp at position 61; Gln, Tyr, His, Ile, Phe, or Val at position 62; and/or Leu, Trp, Arg, Asn, or Tyr at position 63. In some embodiments, the modified CH2 domain polypeptide comprises Arg at position 58; Tyr or Trp at position 59; Glu at position 60; Trp at position 61; and/or Arg or Trp at position 63.

In some embodiments, a modified CH2 domain polypeptide that specifically binds transferrin receptor has at least 70% identity, at least 75% identity, at least 80% identity, at least 85% identity, at least 90% identity, or at least 95% identity to amino acids 4-113 of any one of SEQ ID NOS:47-62. In some embodiments, such a modified CH2 domain polypeptide comprises amino acids 47-49 and/or amino acids 56-63 of any one of SEQ ID NOS:47-62.

In some embodiments, a modified CH2 domain polypeptide of the present invention has at least 70% identity, at least 75% identity, at least 80% identity, at least 85% identity, at least 90% identity, or at least 95% identity to amino acids 4-113 of SEQ ID NO:1, with the proviso that the percent identity does not include the set of positions 47, 49, 56, 58, 59, 60, 61, 62, and 63. In some embodiments, the modified CH2 domain polypeptide comprises amino acids 47-49 and/or amino acids 56-63 as set forth in any one of SEQ ID NOS:47-62.

In some embodiments, a transferrin receptor-binding polypeptide comprises the amino acid sequence of any one of SEQ ID NOS:158-171. In other embodiments, a transferrin receptor-binding polypeptide comprises the amino acid sequence of any one of SEQ ID NOS:158-171, but in which one amino acid is substituted.

In some embodiments, a transferrin receptor-binding polypeptide comprises the amino acid sequence of any one of SEQ ID NOS:172-186. In other embodiments, a transferrin receptor-binding polypeptide comprises the amino acid sequence of any one of SEQ ID NOS:172-186, but in which one amino acid is substituted or in which two amino acids are substituted. In other embodiments, a transferrin receptor-binding polypeptide comprises the amino acid sequence of any one of SEQ ID NOS:172-186, but in which three or four amino acids are substituted.

In additional embodiments, a transferrin receptor-binding polypeptide comprises amino acids 47-63 of any one of SEQ ID NOS:47-62. In further embodiments, the polypeptide may comprise an amino acid sequence having at least 75% identity, at least 80% identity, at least 85% identity, at least 90% identity, or at least 95% identity to amino acids 47-63 of any one of SEQ ID NOS:47-62.

In some embodiments, the polypeptide comprises any one of SEQ ID NOS:47-62. In further embodiments, the polypeptide comprises any one of SEQ ID NOS:47-62 without the first three amino acids "PCP" at the amino-terminal end. In further embodiments, the polypeptide may have at least 75% identity, at least 80% identity, at least 85% identity, at least 90% identity, or at least 95% identity to any one of SEQ ID NOS:47-62 or to any one of SEQ ID NOS:47-62 as determined without the first three amino acids "PCP" at the amino-terminal end.

CH2 Transferrin Receptor Binding Set (iv): 39, 40, 41, 42, 43, 44, 68, 70, 71, and 72

In some embodiments, a modified CH2 domain polypeptide in accordance with the invention comprises at least three or at least four, and typically five, six, seven, eight, nine, or ten substitutions in a set of amino acid positions comprising 39, 40, 41, 42, 43, 44, 68, 70, 71, and 72 (set iv). Illustrative substitutions that may be introduced at these positions are shown in Table 2. In some embodiments, the modified CH2 domain polypeptide comprises Pro at position 43, Glu at position 68, and/or Tyr at position 70. In some embodiments, the modified CH2 domain polypeptide comprises at least one substitution at a position as follows: Pro, Phe, Ala, Met, or Asp at position 39; Gln, Pro, Arg, Lys, Ala, Ile, Leu, Glu, Asp, or Tyr at position 40; Thr, Ser, Gly, Met, Val, Phe, Trp, or Leu at position 41; Pro, Val, Ala, Thr, or Asp at position 42; Pro, Val, or Phe at position 43; Trp, Gln, Thr, or Glu at position 44; Glu, Val, Thr, Leu, or Trp at position 68; Tyr, His, Val, or Asp at position 70; Thr, His, Gln, Arg, Asn, or Val at position 71; or Tyr, Asn, Asp, Ser, or Pro at position 72. In some embodiments, two, three, four, five, six, seven, eight, nine, or all ten of positions 39, 40, 41, 42, 43, 44, 68, 70, 71, and 72 have a substitution as specified in this paragraph. In some embodiments, a modified CH2 domain polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set.

In some embodiments, a modified CH2 domain polypeptide comprises Pro, Phe, or Ala at position 39; Gln, Pro, Arg, Lys, Ala, or Ile at position 40; Thr, Ser, Gly, Met, Val, Phe, or Trp at position 41; Pro, Val, or Ala at position 42; Pro at position 43; Trp or Gln at position 44; Glu at position 68; Tyr at position 70; Thr, His, or Gln at position 71; and/or Tyr, Asn, Asp, or Ser at position 72.

In some embodiments, a modified CH2 domain polypeptide comprises Met at position 39; Leu or Glu at position 40; Trp at position 41; Pro at position 42; Val at position 43; Thr at position 44; Val or Thr at position 68; His at position 70; His, Arg, or Asn at position 71; and/or Pro at position 72.

In some embodiments, a modified CH2 domain polypeptide comprises Asp at position 39; Asp at position 40; Leu at position 41; Thr at position 42; Phe at position 43; Gln at position 44; Val or Leu at position 68; Val at position 70; Thr at position 71; and/or Pro at position 72.

In some embodiments, a modified CH2 domain polypeptide that specifically binds transferrin receptor has at least 70% identity, at least 75% identity, at least 80% identity, at least 85% identity, at least 90% identity, or at least 95% identity to amino acids 4-113 of any one of SEQ ID NOS:63-85. In some embodiments, such a modified CH2 domain polypeptide comprises amino acids 39-44 and/or amino acids 68-72 of any one of SEQ ID NOS:63-85.

In some embodiments, a modified CH2 domain polypeptide of the present invention has at least 70% identity, at least 75% identity, at least 80% identity, at least 85% identity, at least 90% identity, or at least 95% identity to amino acids 4-113 of SEQ ID NO:1, with the proviso that the percent identity does not include the set of positions 39, 40, 41, 42, 43, 44, 68, 70, 71, and 72. In some embodiments, the modified CH2 domain polypeptide comprises amino acids 39-44 and/or amino acids 68-72 as set forth in any one of SEQ ID NOS:63-85.

In some embodiments, a transferrin receptor-binding polypeptide comprises the amino acid sequence of any one of SEQ ID NOS:187-204. In other embodiments, a transferrin receptor-binding polypeptide comprises the amino acid sequence of any one of SEQ ID NOS:187-204, but in which one or two amino acids are substituted. In other embodiments, a transferrin receptor-binding polypeptide comprises the amino acid sequence of any one of claims 187-204, but in which three amino acids are substituted.

In some embodiments, a transferrin receptor-binding polypeptide comprises the amino acid sequence of any one of SEQ ID NOS:205-215. In other embodiments, a transferrin receptor-binding polypeptide comprises the amino acid sequence of any one of SEQ ID NOS:205-215, but in which one amino acid is substituted or in which two amino acids are substituted.

In additional embodiments, a transferrin receptor-binding polypeptide comprises amino acids 39-72 of any one of SEQ ID NOS:63-85. In further embodiments, the polypeptide comprises an amino acid sequence having at least 75% identity, at least 80% identity, at least 85% identity, at least 90% identity, or at least 95% identity to amino acids 39-72 of any one of SEQ ID NOS:63-85.

In some embodiments, the polypeptide comprises any one of SEQ ID NOS:63-85. In further embodiments, the polypeptide comprises any one of SEQ ID NOS:63-85 without the first three amino acids "PCP" at the amino-terminal end. In further embodiments, the polypeptide may have at least 75% identity, at least 80% identity, at least 85% identity, at least 90% identity, or at least 95% identity to any one of SEQ ID NOS:63-85 or to any one of SEQ ID NOS:63-85 as determined without the first three amino acids "PCP" at the amino-terminal end.

CH2 Transferrin Receptor Binding Set (v): 41, 42, 43, 44, 45, 65, 66, 67, 69, and 73

In some embodiments, a modified CH2 domain polypeptide in accordance with the invention comprises at least three or at least four, and typically five, six, seven, eight, nine, or ten substitutions in a set of amino acid positions comprising 41, 42, 43, 44, 45, 65, 66, 67, 69, and 73 (set v). Illustrative substitutions that may be introduced at these positions are shown in Table 3. In some embodiments, the modified CH2 domain polypeptide comprises at least one substitution at a position as follows: Val or Asp at position 41; Pro, Met, or Asp at position 42; Pro or Trp at position 43; Arg, Trp, Glu, or Thr at position 44; Met, Tyr, or Trp at position 45; Leu or Trp at position 65; Thr, Val, Ile, or Lys at position 66; Ser, Lys, Ala, or Leu at position 67; His, Leu, or Pro at position 69; or Val or Trp at position 73. In some embodiments, two, three, four, five, six, seven, eight, nine, or all ten of positions 41, 42, 43, 44, 45, 65, 66, 67, 69, and 73 have a substitution as specified in this paragraph. In some embodiments, a modified CH2 domain polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set.

In some embodiments, the modified CH2 domain polypeptide comprises Val at position 41; Pro at position 42; Pro at position 43; Arg or Trp at position 44; Met at position 45; Leu at position 65; Thr at position 66; Ser at position 67; His at position 69; and/or Val at position 73.

In some embodiments, the modified CH2 domain polypeptide comprises Asp at position 41; Met or Asp at position 42; Trp at position 43; Glu or Thr at position 44; Tyr or Trp at position 45; Trp at position 65; Val, Ile, or Lys at position 66; Lys, Ala, or Leu at position 67; Leu or Pro at position 69; and/or Trp at position 73.

In some embodiments, a modified CH2 domain polypeptide that specifically binds transferrin receptor has at least 70% identity, at least 75% identity, at least 80% identity, at least 85% identity, at least 90% identity, or at least 95% identity to amino acids 4-113 of any one of SEQ ID NOS:86-90. In some embodiments, such a modified CH3 domain polypeptide comprises amino acids 41-45 and/or amino acids 65-73 of any one of SEQ ID NOS:86-90.

In some embodiments, a modified CH2 domain polypeptide of the present invention has at least 70% identity, at least 75% identity, at least 80% identity, at least 85% identity, at least 90% identity, or at least 95% identity to amino acids 4-113 of SEQ ID NO:1, with the proviso that the percent identity does not include the set of positions 41, 42, 43, 44, 45, 65, 66, 67, 69, and 73. In some embodiments, the modified CH2 domain polypeptide comprises amino acids 41-45 and/or amino acids 65-73 as set forth in any one of SEQ ID NOS:86-90.

In some embodiments, a transferrin receptor-binding polypeptide comprises the amino acid sequence of any one of SEQ ID NOS:216-220. In other embodiments, a transferrin receptor-binding polypeptide comprises the amino acid sequence of any one of SEQ ID NOS:216-220, but in which one or two amino acids are substituted.

In some embodiments, a transferrin receptor-binding polypeptide comprises the amino acid sequence of any one of SEQ ID NOS:221-224. In other embodiments, a transferrin receptor-binding polypeptide comprises the amino acid sequence of any one of SEQ ID NOS:221-224, but in which one amino acid is substituted or in which two amino acids are substituted. In other embodiments, a transferrin receptor-binding polypeptide comprises the amino acid sequence of any one of SEQ ID NOS:221-224, but in which three or four amino acids are substituted.

In additional embodiments, a transferrin receptor-binding polypeptide comprises amino acids 41-73 of any one of SEQ ID NOS:86-90. In further embodiments, the polypeptide may comprise a sequence having at least 75% identity, at least 80% identity, at least 85% identity, at least 90% identity, or at least 95% identity to amino acids 41-73 of any one of SEQ ID NOS:86-90.

In some embodiments, the polypeptide comprises any one of SEQ ID NOS:86-90. In further embodiments, the polypeptide comprises any one of SEQ ID NOS:86-90 without the first three amino acids "PCP" at the amino-terminal end. In further embodiments, the polypeptide may have at least 75% identity, at least 80% identity, at least 85% identity, at least 90% identity, or at least 95% identity to any one of SEQ ID NOS:86-90 or to any one of SEQ ID NOS:86-90 as determined without the first three amino acids "PCP" at the amino-terminal end.

CH2 Transferrin Receptor Binding Set (vi): 45, 47, 49, 95, 97, 99, 102, 103, and 104

In some embodiments, a modified CH2 domain polypeptide in accordance with the invention comprises at least three or at least four, and typically five, six, seven, eight, or nine substitutions in a set of amino acid positions comprising 45, 47, 49, 95, 97, 99, 102, 103, and 104 (set vi). Illustrative substitutions that may be introduced at these positions are shown in Table 4. In some embodiments, the modified CH2 domain polypeptide comprises Trp at position 103. In some embodiments, the modified CH2 domain polypeptide comprises at least one substitution at a position as follows: Trp, Val, Ile, or Ala at position 45; Trp or Gly at position 47; Tyr, Arg, or Glu at position 49; Ser, Arg, or Gln at position 95; Val, Ser, or Phe at position 97; Ile, Ser, or Trp at position 99; Trp, Thr, Ser, Arg, or Asp at position 102; Trp at position 103; or Ser, Lys, Arg, or Val at position 104. In some embodiments, two, three, four, five, six, seven, eight, or all nine of positions 45, 47, 49, 95, 97, 99, 102, 103, and 104 have a substitution as specified in this paragraph. In some embodiments, a modified CH2 domain polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set.

In some embodiments, the modified CH2 domain polypeptide comprises two, three, four, five, six, seven, eight, or nine positions selected from the following: position 45 is Trp, Val, Ile, or Ala; position 47 is Trp or Gly; position 49 is Tyr, Arg, or Glu; position 95 is Ser, Arg, or Gln; position 97 is Val, Ser, or Phe; position 99 is Ile, Ser, or Trp; position 102 is Trp, Thr, Ser, Arg, or Asp; position 103 is Trp; and position 104 is Ser, Lys, Arg, or Val.

In some embodiments, the modified CH2 domain polypeptide comprises Val or Ile at position 45; Gly at position 47; Arg at position 49; Arg at position 95; Ser at position 97; Ser at position 99; Thr, Ser, or Arg at position 102; Trp at position 103; and/or Lys or Arg at position 104.

In some embodiments, a modified CH2 domain polypeptide that specifically binds transferrin receptor has at least 70% identity, at least 75% identity, at least 80% identity, at least 85% identity, at least 90% identity, or at least 95% identity to amino acids 4-113 of any one of SEQ ID NOS:91-95. In some embodiments, such a modified CH3 domain polypeptide comprises amino acids 45-49 and/or amino acids 95-104 of any one of SEQ ID NOS:91-95.

In some embodiments, a modified CH2 domain polypeptide of the present invention has at least 70% identity, at least 75% identity, at least 80% identity, at least 85% identity, at least 90% identity, or at least 95% identity to amino acids 4-113 of SEQ ID NO:1, with the proviso that the percent identity does not include the set of positions 45, 47, 49, 95, 97, 99, 102, 103, and 104. In some embodiments, the modified CH2 domain polypeptide comprises amino acids 45-49 and/or amino acids 95-104 as set forth in any one of SEQ ID NOS:91-95.

In some embodiments, a transferrin receptor-binding polypeptide comprises the amino acid sequence of any one of SEQ ID NOS:225-228. In other embodiments, a transferrin receptor-binding polypeptide comprises the amino acid sequence of any one of SEQ ID NOS:225-228, but in which one or two amino acids are substituted.

In some embodiments, a transferrin receptor-binding polypeptide comprises the amino acid sequence of any one of SEQ ID NOS:229-233. In other embodiments, a transferrin receptor-binding polypeptide comprises the amino acid sequence of any one of SEQ ID NOS:229-223, but in which one amino acid is substituted or in which two amino acids are substituted. In other embodiments, a transferrin receptor-binding polypeptide comprises the amino acid sequence of any one of SEQ ID NOS:229-233, but in which three, four, or five amino acids are substituted.

In additional embodiments, a transferrin receptor-binding polypeptide comprises amino acids 45-104 of any one of SEQ ID NOS:91-95. In further embodiments, the polypeptide may have at least 75% identity, at least 80% identity, at least 85% identity, at least 90% identity, or at least 95% identity to amino acids 45-104 of any one of SEQ ID NOS:91-95.

In some embodiments, the polypeptide comprises any one of SEQ ID NOS:91-95. In further embodiments, the polypeptide comprises any one of SEQ ID NOS:91-95 without the first three amino acids "PCP" at the amino-terminal end. In further embodiments, the polypeptide may have at least 75% identity, at least 80% identity, at least 85% identity, at least 90% identity, or at least 95% identity to any one of SEQ ID NOS:91-95 or to any one of SEQ ID NOS:91-95 as determined without the first three amino acids "PCP" at the amino-terminal end.

Illustrative Polypeptides Comprising Modified CH3 or CH2 Domains

A modified CH3 or CH2 domain polypeptide of the present invention may be joined to another domain of an Fc region. In some embodiments, a modified CH3 domain polypeptide of the present invention is joined to a CH2 domain, which may be a naturally occurring CH2 domain or a variant CH2 domain, typically at the C-terminal end of the CH3 domain. In some embodiments, a modified CH2 domain polypeptide of the present invention is joined to a CH3 domain, which may be a naturally occurring CH3 domain or a CH3 variant domain, typically at the N-terminal end of the CH3 domain. In some embodiments, the polypeptide comprising a modified CH2 domain joined to a CH3 domain, or the polypeptide comprising the modified CH3 domain joined to a CH2 domain, further comprises a partial or full hinge region of an antibody, thus resulting in a format in which the modified CH3 domain polypeptide or modified CH2 domain polypeptide is part of an Fc region having a partial or full hinge region. The hinge region can be from any immunoglobulin subclass or isotype. An illustrative immunoglobulin hinge is an IgG hinge region, such as an IgG1 hinge region, e.g., human IgG1 hinge amino acid sequence EPKSCDKTHTCPPCP (SEQ ID NO:234). In further embodiments, the polypeptide, which may be in an Fc format containing a hinge or partial hinge region, is further joined to another moiety, for example, a Fab fragment, thus generating a transferrin receptor-binding Fc-Fab fusion. In some embodiments, the transferrin receptor-binding Fc-Fab fusion comprises a modified CH3 domain polypeptide or modified CH2 domain polypeptide, a hinge region, and a Fab fragment. The Fab fragment may be to any target of interest, e.g., a therapeutic neurological target, where the Fab is delivered to the target by transcytosis across the blood-brain barrier mediated by the binding of the modified CH3 domain polypeptide or modified CH2 domain polypeptide to the transferrin receptor.

In some embodiments, a Fab fragment joined to a transferrin receptor-binding polypeptide may bind to a Tau protein (e.g., a human Tau protein) or a fragment thereof. In some embodiments, the Fab fragment may bind to a phosphorylated Tau protein, an unphosphorylated Tau protein, a splice isoform of Tau protein, an N-terminal truncated Tau protein, a C-terminal truncated Tau protein, and/or a fragment thereof.

In some embodiments, a Fab fragment joined to a transferrin receptor-binding polypeptide may bind to a beta-secretase 1 (BACE1) protein (e.g., a human BACE1 protein) or a fragment thereof. In some embodiments, the Fab fragment may bind to one or more splice isoforms of BACE1 protein or a fragment thereof.

In some embodiments, a Fab fragment joined to a transferrin receptor-binding polypeptide may bind to a triggering receptor expressed on myeloid cells 2 (TREM2) protein (e.g., a human TREM2 protein) or a fragment thereof.

In some embodiments, a Fab fragment joined to a transferrin receptor-binding polypeptide may bind to an alpha-synuclein protein (e.g., a human alpha-synuclein protein) or a fragment thereof. In some embodiments, the Fab fragment may bind to a monomeric alpha-synuclein, oligomeric alpha-synuclein, alpha-synuclein fibrils, soluble alpha-synuclein, and/or a fragment thereof.

In some embodiments, an Fc-Fab fusion comprising a modified CH2 or CH3 domain polypeptide of the present invention is a subunit of a dimer. In some embodiments, the dimer is a heterodimer. In some embodiments, the dimer is a homodimer. In some embodiments, the dimer comprises a single polypeptide that binds to the transferrin receptor, i.e., is monovalent for transferrin receptor binding. In some embodiments, the dimer comprises a second polypeptide that binds to the transferrin receptor. The second polypeptide may comprise the same modified CH3 domain polypeptide (or modified CH2 domain polypeptide) present in the Fc-Fab fusion to provide a bivalent binding homodimer, or a second modified CH3 domain polypeptide (or modified CH2 domain polypeptide) of the present invention may provide a second transferrin receptor binding site. In some embodiments, the dimer comprises a first subunit in which comprising a modified CH3 domain polypeptide or modified CH2 domain polypeptide and a second subunit comprising CH2 and CH3 domains where neither binds transferrin receptor.

The transferrin receptor-binding polypeptide may also be fused to a different polypeptide of interest other than a Fab. For example, in some embodiments, the transferrin receptor-binding polypeptide may be fused to a different polypeptide that is desirable to target to a transferrin receptor-expressing cell or to deliver across an endothelium, e.g., the blood-brain barrier, by trancytosis. In some embodiments, the transferrin receptor-binding polypeptide is fused to a soluble protein, e.g., an extracellular domain of a receptor or a growth factor, a cytokine, or an enzyme.

In still other embodiments, the transferrin receptor-binding polypeptide may be fused to a peptide or protein useful in protein purification, e.g, polyhistidine, epitope tags, e.g., FLAG, c-Myc, hemagglutinin tags and the like, glutathione S transferase (GST), thioredoxin, protein A, protein G, or maltose binding protein (MBP). In some cases, the peptide or protein to which the transferrin receptor-binding polypeptide is fused may comprise a protease cleavage site, such as a cleavage site for Factor Xa or Thrombin.

Transferrin receptor-binding polypeptides of the present invention may have a broad range of binding affinities, e.g., based on the format of the polypeptide. For example, in some embodiments, a polypeptide comprising a modified CH3 domain or modified CH2 domain has an affinity for transferrin receptor binding ranging anywhere from 1 pM to 10 µM. In some embodiments, affinity may be measured in a monovalent format. In other embodiments, affinity may be measured in a bivalent format, e.g., as a dimer comprising a polypeptide-Fab fusion protein.

Methods for analyzing binding affinity, binding kinetics, and cross-reactivity are known in the art. These methods include, but are not limited to, solid-phase binding assays (e.g., ELISA assay), immunoprecipitation, surface plasmon resonance (e.g., Biacore™ (GE Healthcare, Piscataway, N.J.)), kinetic exclusion assays (e.g., KinExA®)), flow cytometry, fluorescence-activated cell sorting (FACS), Bio-Layer interferometry (e.g., Octet® (FortéBio, Inc., Menlo Park, Calif.)), and Western blot analysis. In some embodiments, ELISA is used to determine binding affinity and/or cross-reactivity. Methods for performing ELISA assays are known in the art and are also described in the Example section below. In some embodiments, surface plasmon resonance (SPR) is used to determine binding affinity, binding kinetics, and/or cross-reactivity. In some embodiments, kinetic exclusion assays are used to determine binding affinity, binding kinetics, and/or cross-reactivity. In some embodiments, BioLayer interferometry assays are used to determine binding affinity, binding kinetics, and/or cross-reactivity.

Additional mutations in an Fc region that comprises a modified CH3 or CH2 domain polypeptide A polypeptide as provided herein that is modified to bind a transferrin receptor and initiate transport across the BBB may also comprise additional mutations, e.g., to increase serum stability, to modulate effector function, to influence glyscosylation, to reduce immunogenicity in humans, and/or to provide for knob and hole heterodimerization of the polypeptide.

In some embodiments, a polypeptide in accordance with the invention has an amino acid sequence identity of at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% to a corresponding wild-type Fc region (e.g., a human IgG1, IgG2, IgG3, or IgG4 Fc region).

A polypeptide in accordance with the invention may also have other mutations introduced outside of the specified sets of amino acids, e.g., to influence glycosylation, to increase serum half-life or, for CH3 domains, to provide for knob and hole heterodimerization of polypeptides that comprise the modified CH3 domain. Generally, the method involves introducing a protuberance ("knob") at the interface of a first polypeptide and a corresponding cavity ("hole") in the interface of a second polypeptide, such that the protuberance can be positioned in the cavity so as to promote heterodimer formation and hinder homodimer formation. Protuberances are constructed by replacing small amino acid side chains from the interface of the first polypeptide with larger side chains (e.g., tyrosine or tryptophan). Compensatory cavities of identical or similar size to the protuberances are created in the interface of the second polypeptide by replacing large amino acid side chains with smaller ones (e.g., alanine or threonine). Such additional mutations are at a position in the polypeptide that does not have a negative effect on binding of the modified CH3 or CH2 domain to the transferrin receptor.

In one illustrative embodiment of a knob and hole approach for dimerization, a position corresponding to position 139 of SEQ ID NO:1 of a first Fc polypeptide subunit to be dimerized has a tryptophan in place of a native threonine and a second Fc polypeptide subunit of the dimer has a valine at a position corresponding to position 180 of SEQ ID NO:1 in place of the native tyrosine. The second subunit of the Fc polypeptide may further comprise a substitution in which the native threonine at the position corresponding to position 139 of SEQ ID NO:1 is substituted with a serine and a native leucine at the position corresponding to position 141 of SEQ ID NO:1 is substituted with an alanine.

A polypeptide as described herein may also be engineered to contain other modifications for heterodimerization, e.g., electrostatic engineering of contact residues within a CH3-CH3 interface that are naturally charged or hydrophobic patch modifications.

In some embodiments, modifications to enhance serum half-life may be introduced. For example, in some embodiments, an Fc region comprises a CH2 domain comprising a Tyr at a position corresponding to position 25 of SEQ ID NO:1, Thr at a position corresponding to 27 of SEQ ID NO:1, and Glu at a position corresponding to position 29 of SEQ ID NO:1.

In some embodiments, a mutation, e.g., a substitution, is introduced at one or more of positions 17-30, 52-57, 80-90, 156-163, and 201-208 as determined with reference to SEQ ID NO:1. In some embodiments, one or more mutations are introduced at positions 24, 25, 27, 28, 29, 80, 81, 82, 84, 85, 87, 158, 159, 160, 162, 201, 206, 207, or 209 as determined with reference to SEQ ID NO:1. In some embodiments, mutations are introduced into one, two, or three of positions 25, 27, and 29 as determined with reference to SEQ ID NO:1. In some embodiments, the mutations are M25Y, S27T, and T29E as numbered with reference to SEQ ID NO:1. In some embodiments, a polypeptide as described herein further comprises mutations M25Y, S27T, and T29E. In some embodiments, mutations are introduced into one or two of positions 201 and 207 as determined with reference to SEQ ID NO:1. In some embodiments, the mutations are M201L and N207S as numbered with reference to SEQ ID NO:1. In some embodiments, a polypeptide as described herein further comprises mutation N207S with or without M201L. In some embodiments, a polypeptide as described herein comprises a substitution at one, two or all three of positions T80, E153, and N207 as numbered with reference to SEQ ID NO:1. In some embodiments, the mutations are T80Q and N207A. In some embodiments, a polypeptide as described herein comprises mutations T80A, E153A, and N207A. In some embodiments, a polypeptide as described herein comprises substitutions at positions T23 and M201 as numbered with reference to SEQ ID NO:1. In some embodiments, a polypeptide as described herein comprises mutations T23Q and M201L. In some embodiments, a polypeptide as described herein comprises substitutions at positions M201 and N207 as numbered with reference to SEQ ID NO:1. In some embodiments, a polypeptide as described herein comprises substitutions M201L and N207S. In some embodiments, a polypeptide as described herein comprises an N207S or N207A substitution.

Fc Effector Functions

In some embodiments, an Fc region comprising a modified CH2 or CH3 domain has an effector function, i.e., they have the ability to induce certain biological functions upon binding to an Fc receptor expressed on an effector cell that mediates the effector function. Effector cells include, but are not limited to, monocytes, macrophages, neutrophils, dendritic cells, eosinophils, mast cells, platelets, B cells, large granular lymphocytes, Langerhans' cells, natural killer (NK) cells, and cytotoxic T cells.

Examples of antibody effector functions include, but are not limited to, C1q binding and complement dependent cytotoxicity (CDC), Fc receptor binding, antibody-dependent cell-mediated cytotoxicity (ADCC), antibody-dependent cell-mediated phagocytosis (ADCP), down-regulation of cell surface receptors (e.g., B cell receptor), and B-cell activation. Effector functions may vary with the antibody class. For example, native human IgG1 and IgG3 antibodies can elicit ADCC and CDC activities upon binding to an appropriate Fc receptor present on an immune system cell; and native human IgG1, IgG2, IgG3, and IgG4 can elicit ADCP functions upon binding to the appropriate Fc receptor present on an immune cell.

In some embodiments, a polypeptide as described herein may include additional modifications that reduce effector function. Alternatively, in some embodiments, a polypeptide comprising a modified CH2 or CH3 domain of the invention may include additional modifications that enhance effector function.

Illustrative Fc Polypeptide Mutations that Modulate an Effector Function Include, but are not Limited to, Substitutions in a CH2 Domain, e.g., at Positions Corresponding to Positions 7 and 8 of SEQ ID NO:1. In some embodiments, the substitutions in a modified CH2 domain comprise Ala at positions 7 and 8 of SEQ ID NO:1. In some embodiments, the substitutions in a modified CH2 domain comprise Ala at positions 7 and 8 and Gly at position 102 of SEQ ID NO:1.

Additional Fc polypeptide mutations that modulate an effector function include, but are not limited to, one or more substitutions at positions 238, 265, 269, 270, 297, 327 and 329 (EU numbering scheme, which correspond to positions 11, 38, 42, 43, 70, 100, and 102 as numbered with reference to SEQ ID NO:1). Illustrative substitutions (as numbered with EU numbering scheme), include the following: position 329 may have a mutation in which proline is substituted with a glycine or arginine or an amino acid residue large enough to destroy the Fc/Fcγ receptor interface that is formed between proline 329 of the Fc and tryptophan residues Trp 87 and Trp 110 of FcγRIII. Additional illustrative substitutions include S228P, E233P, L235E, N297A, N297D, and P331S. Multiple substitutions may also be present, e.g., L234A and L235A of a human IgG1 Fc region; L234A, L235A, and P329G of a human IgG1 Fc region; S228P and L235E of a human IgG4 Fc region; L234A and G237A of a human IgG1 Fc region; L234A, L235A, and G237A of a human IgG1 Fc region; V234A and G237A of a human IgG2 Fc region; L235A, G237A, and E318A of a human IgG4 Fc region; and S228P and L236E of a human IgG4 Fc region. In some embodiments, a polypeptide of the invention may have one or more amino acid substitutions that modulate ADCC, e.g., substitutions at positions 298, 333, and/or 334 of the Fc region, according to the EU numbering scheme.

In some embodiments, a polypeptide as described herein may have one or more amino acid substitutions that increase or decrease ADCC or may have mutations that alter C1q binding and/or CDC.

Illustrative Polypeptides Comprising Additional Mutations

A polypeptide as described herein (e.g., any one of clones CH3C.35.20.1, CH3C.35.23.2, CH3C.35.23.3, CH3C.35.23.4, CH3C.35.21.17.2, CH3C.35.23, CH3C.35.21, CH3C.35.20.1.1, CH3C.23.2.1, and CH3C.35.23.1.1) may comprise additional mutations including a knob mutation (e.g., T139W as numbered with reference to SEQ ID NO:1), hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), and/or mutations that increase serum stability (e.g., (i) M25Y, S27T, and T29E as numbered with reference to SEQ ID NO:1, or (ii) N207S with or without M201L as numbered with reference to SEQ ID NO:1).

In some embodiments, a polypeptide as described herein (e.g., any one of clones CH3C.35.20.1, CH3C.35.23.2, CH3C.35.23.3, CH3C.35.23.4, CH3C.35.21.17.2, CH3C.35.23, CH3C.35.21, CH3C.35.20.1.1, CH3C.23.2.1, and CH3C.35.23.1.1) may have a knob mutation (e.g., T139W as numbered with reference to SEQ ID NO:1) and at least 85% identity, at least 90% identity, or at least 95% identity to the sequence of any one of SEQ ID NOS:4-95, 236-299, and 422-435. In some embodiments, a polypeptide having the sequence of any one of SEQ ID NOS:4-95, 236-299, and 422-435 may be modified to have a knob mutation.

In some embodiments, a polypeptide as described herein (e.g., any one of clones CH3C.35.20.1, CH3C.35.23.2, CH3C.35.23.3, CH3C.35.23.4, CH3C.35.21.17.2, CH3C.35.23, CH3C.35.21, CH3C.35.20.1.1, CH3C.23.2.1, and CH3C.35.23.1.1) may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of any one of SEQ ID NOS:4-95, 236-299, and 422-435. In some embodiments, a polypeptide having the sequence of any one of SEQ ID NOS:4-95, 236-299, and 422-435 may be modified to have a knob mutation and mutations that modulate effector function.

In some embodiments, a polypeptide as described herein (e.g., any one of clones CH3C.35.20.1, CH3C.35.23.2, CH3C.35.23.3, CH3C.35.23.4, CH3C.35.21.17.2, CH3C.35.23, CH3C.35.21, CH3C.35.20.1.1, CH3C.23.2.1, and CH3C.35.23.1.1) a knob mutation (e.g., T139W as numbered with reference to SEQ ID NO:1), mutations that increase serum stability (e.g., (i) M25Y, S27T, and T29E as numbered with reference to SEQ ID NO:1, or (ii) N207S with or without M201L as numbered with reference to SEQ ID NO:1), and at least 85% identity, at least 90% identity, or at least 95% identity to the sequence of any one of SEQ ID NOS:4-95, 236-299, and 422-435. In some embodiments, a polypeptide having the sequence of any one of SEQ ID NOS:4-95, 236-299, and 422-435 may be modified to have a knob mutation and mutations that increase serum stability.

In some embodiments, a polypeptide as described herein (e.g., any one of clones CH3C.35.20.1, CH3C.35.23.2, CH3C.35.23.3, CH3C.35.23.4, CH3C.35.21.17.2, CH3C.35.23, CH3C.35.21, CH3C.35.20.1.1, CH3C.23.2.1, and CH3C.35.23.1.1) may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., (i) M25Y, S27T, and T29E as numbered with reference to SEQ ID NO:1, or (ii) N207S with or without M201L as numbered with reference to SEQ ID NO:1), and at least 85% identity, at least 90% identity, or at least 95% identity to the sequence of any one of SEQ ID NOS:4-95, 236-299, and 422-435. In some embodiments, a polypeptide having the sequence of any one of SEQ ID NOS:4-95, 236-299, and 422-435 may be modified to have a knob mutation, mutations that modulate effector function, and mutations that increase serum stability.

In some embodiments, a polypeptide as described herein (e.g., any one of clones CH3C.35.20.1, CH3C.35.23.2, CH3C.35.23.3, CH3C.35.23.4, CH3C.35.21.17.2, CH3C.35.23, CH3C.35.21, CH3C.35.20.1.1, CH3C.23.2.1, and CH3C.35.23.1.1) may have hole mutations (e.g., T139S, L141A, and Y180V as numbered with reference to SEQ ID NO:1) and at least 85% identity, at least 90% identity, or at least 95% identity to the sequence of any one of SEQ ID NOS:4-95, 236-299, and 422-435. In some embodiments, a polypeptide having the sequence of any one of SEQ ID NOS:4-95, 236-299, and 422-435 may be modified to have hole mutations.

In some embodiments, a polypeptide as described herein (e.g., any one of clones CH3C.35.20.1, CH3C.35.23.2, CH3C.35.23.3, CH3C.35.23.4, CH3C.35.21.17.2, CH3C.35.23, CH3C.35.21, CH3C.35.20.1.1, CH3C.23.2.1, and CH3C.35.23.1.1) may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of any one of SEQ ID NOS:4-95, 236-299, and 422-435. In some embodiments, a polypeptide having the sequence of any one of SEQ ID NOS:4-95, 236-299, and 422-435 may be modified to have hole mutations and mutations that modulate effector function.

In some embodiments, a polypeptide as described herein (e.g., any one of clones CH3C.35.20.1, CH3C.35.23.2, CH3C.35.23.3, CH3C.35.23.4, CH3C.35.21.17.2, CH3C.35.23, CH3C.35.21, CH3C.35.20.1.1, CH3C.23.2.1, and CH3C.35.23.1.1) may have hole mutations (e.g., T139S, L141A, and Y180V as numbered with reference to SEQ ID NO:1), mutations that increase serum stability (e.g., (i) M25Y, S27T, and T29E as numbered with reference to SEQ ID NO:1, or (ii) N207S with or without M201L as numbered with reference to SEQ ID NO:1), and at least 85% identity, at least 90% identity, or at least 95% identity to the sequence of any one of SEQ ID NOS:4-95, 236-299, and 422-435. In some embodiments, a polypeptide having the sequence of any one of SEQ ID NOS:4-95, 236-299, and 422-435 may be modified to have hole mutations and mutations that increase serum stability.

In some embodiments, a polypeptide as described herein (e.g., any one of clones CH3C.35.20.1, CH3C.35.23.2, CH3C.35.23.3, CH3C.35.23.4, CH3C.35.21.17.2, CH3C.35.23, CH3C.35.21, CH3C.35.20.1.1, CH3C.23.2.1, and CH3C.35.23.1.1) may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., (i) M25Y, S27T, and T29E as numbered with reference to SEQ ID NO:1, or (ii) N207S with or without M201L as numbered with reference to SEQ ID NO:1), and at least 85% identity, at least 90% identity, or at least 95% identity to the sequence of any one of SEQ ID NOS:4-95, 236-299, and 422-435. In some embodiments, a polypeptide having the sequence of any one of SEQ ID NOS:4-95, 236-299, and 422-435 may be modified to have hole mutations, mutations that modulate effector function, and mutations that increase serum stability.

Clone CH3C.35.20.1

In some embodiments, clone CH3C.35.20.1 may have a knob mutation (e.g., T139W as numbered with reference to SEQ ID NO:1) and at least 85% identity, at least 90% identity, or at least 95% identity to the sequence of SEQ ID NO:349. In some embodiments, clone CH3C.35.20.1 with the knob mutation has the sequence of SEQ ID NO:349.

In some embodiments, clone CH3C.35.20.1 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:350 or 351. In some embodiments, clone CH3C.35.20.1 with the knob mutation and the mutations that modulate effector function has the sequence of SEQ ID NO:350 or 351.

In some embodiments, clone CH3C.35.20.1 may have a knob mutation (e.g., T139W as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:352. In some embodiments, clone CH3C.35.20.1 with the knob mutation and the mutations that increase serum stability has the sequence of SEQ ID NO:352.

In some embodiments, clone CH3C.35.20.1 may have a knob mutation (e.g., T139W as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:485. In some embodiments, clone CH3C.35.20.1 with the knob mutation and the mutations that increase serum stability has the sequence of SEQ ID NO:485.

In some embodiments, clone CH3C.35.20.1 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:353 or 354. In some embodiments, clone CH3C.35.20.1 with the knob mutation, the mutations that modulate effector function, and the mutations that increase serum stability has the sequence of SEQ ID NO:353 or 354.

In some embodiments, clone CH3C.35.20.1 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:486 or 487. In some embodiments, clone CH3C.35.20.1 with the knob mutation, the mutations that modulate effector function, and the mutations that increase serum stability has the sequence of SEQ ID NO: 486 or 487.

In some embodiments, clone CH3C.35.20.1 may have hole mutations (e.g., T139S, L141A, and Y180V as numbered with reference to SEQ ID NO:1) and at least 85% identity, at least 90% identity, or at least 95% identity to the sequence of SEQ ID NO:355. In some embodiments, clone CH3C.35.20.1 with the hole mutations has the sequence of SEQ ID NO:355.

In some embodiments, clone CH3C.35.20.1 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:356 or 357. In some embodiments, clone CH3C.35.20.1 with the hole mutations and the mutations that modulate effector function has the sequence of SEQ ID NO:356 or 357.

In some embodiments, clone CH3C.35.20.1 may have hole mutations (e.g., T139S, L141A, and Y180V as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:358. In some embodiments, clone CH3C.35.20.1 with the hole mutations and the mutations that increase serum stability has the sequence of SEQ ID NO:358.

In some embodiments, clone CH3C.35.20.1 may have hole mutations (e.g., T139S, L141A, and Y180V as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO: 488. In some embodiments, clone CH3C.35.20.1 with the hole mutations and the mutations that increase serum stability has the sequence of SEQ ID NO:488.

In some embodiments, clone CH3C.35.20.1 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:359 or 360. In some embodiments, clone CH3C.35.20.1 with the hole mutations, the mutations that modulate effector function, and the mutations that increase serum stability has the sequence of SEQ ID NO:359 or 360.

In some embodiments, clone CH3C.35.20.1 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:489 or 490. In some embodiments, clone CH3C.35.20.1 with the hole mutations, the mutations that modulate effector function, and the mutations that increase serum stability has the sequence of SEQ ID NO:489 or 490.

Clone CH3C.35.23.2

In some embodiments, clone CH3C.35.23.2 may have a knob mutation (e.g., T139W as numbered with reference to SEQ ID NO:1) and at least 85% identity, at least 90% identity, or at least 95% identity to the sequence of SEQ ID NO:361. In some embodiments, clone CH3C.35.23.2 with the knob mutation has the sequence of SEQ ID NO:361.

In some embodiments, clone CH3C.35.23.2 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:362 or 363. In some embodiments, clone CH3C.35.23.2 with the knob mutation and the mutations that modulate effector function has the sequence of SEQ ID NO:362 or 363.

In some embodiments, clone CH3C.35.23.2 may have a knob mutation (e.g., T139W as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:364. In some embodiments, clone CH3C.35.23.2 with the knob mutation and the mutations that increase serum stability has the sequence of SEQ ID NO:364.

In some embodiments, clone CH3C.35.23.2 may have a knob mutation (e.g., T139W as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:492. In some embodiments, clone CH3C.35.23.2 with the knob mutation and the mutations that increase serum stability has the sequence of SEQ ID NO:492.

In some embodiments, clone CH3C.35.23.2 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:365 or 366. In some embodiments, clone CH3C.35.23.2 with the knob mutation, the mutations that modulate effector function, and the mutations that increase serum stability has the sequence of SEQ ID NO:365 or 366.

In some embodiments, clone CH3C.35.23.2 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:493 or 494. In some embodiments, clone CH3C.35.23.2 with the knob mutation, the mutations that modulate effector function, and the mutations that increase serum stability has the sequence of SEQ ID NO:493 or 494.

In some embodiments, clone CH3C.35.23.2 may have hole mutations (e.g., T139S, L141A, and Y180V as numbered with reference to SEQ ID NO:1) and at least 85% identity, at least 90% identity, or at least 95% identity to the sequence of SEQ ID NO:367. In some embodiments, clone CH3C.35.23.2 with the hole mutations has the sequence of SEQ ID NO:367.

In some embodiments, clone CH3C.35.23.2 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:368 or 369. In some embodiments, clone CH3C.35.23.2 with the hole mutations and the mutations that modulate effector function has the sequence of SEQ ID NO:368 or 369.

In some embodiments, clone CH3C.35.23.2 may have hole mutations (e.g., T139S, L141A, and Y180V as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:370. In some embodiments, clone CH3C.35.23.2 with the hole mutations and the mutations that increase serum stability has the sequence of SEQ ID NO:370.

In some embodiments, clone CH3C.35.23.2 may have hole mutations (e.g., T139S, L141A, and Y180V as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:495. In some embodiments, clone CH3C.35.23.2 with the hole mutations and the mutations that increase serum stability has the sequence of SEQ ID NO:495.

In some embodiments, clone CH3C.35.23.2 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:371 or 372. In some embodiments, clone CH3C.35.23.2 with the hole mutations, the mutations that modulate effector function, and the mutations that increase serum stability has the sequence of SEQ ID NO:371 or 372.

In some embodiments, clone CH3C.35.23.2 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:496 or 497. In some embodiments, clone CH3C.35.23.2 with the hole mutations, the mutations that modulate effector function, and the mutations that increase serum stability has the sequence of SEQ ID NO:496 or 497.

Clone CH3C.35.23.3

In some embodiments, clone CH3C.35.23.3 may have a knob mutation (e.g., T139W as numbered with reference to SEQ ID NO:1) and at least 85% identity, at least 90% identity, or at least 95% identity to the sequence of SEQ ID NO:373. In some embodiments, clone CH3C.35.23.3 with the knob mutation has the sequence of SEQ ID NO:373.

In some embodiments, clone CH3C.35.23.3 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:374 or 375. In some embodiments, clone CH3C.35.23.3 with the knob mutation and the mutations that modulate effector function has the sequence of SEQ ID NO:374 or 375.

In some embodiments, clone CH3C.35.23.3 may have a knob mutation (e.g., T139W as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:376. In some embodiments, clone CH3C.35.23.3 with the knob mutation and the mutations that increase serum stability has the sequence of SEQ ID NO:376.

In some embodiments, clone CH3C.35.23.3 may have a knob mutation (e.g., T139W as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:499. In some embodiments, clone CH3C.35.23.3 with the knob mutation and the mutations that increase serum stability has the sequence of SEQ ID NO:499.

In some embodiments, clone CH3C.35.23.3 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:377 or 378. In some embodiments, clone CH3C.35.23.3 with the knob mutation, the mutations that modulate effector function, and the mutations that increase serum stability has the sequence of SEQ ID NO:377 or 378.

In some embodiments, clone CH3C.35.23.3 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:500 or 501. In some embodiments, clone CH3C.35.23.3 with the knob mutation, the mutations that modulate effector function, and the mutations that increase serum stability has the sequence of SEQ ID NO:500 or 501.

In some embodiments, clone CH3C.35.23.3 may have hole mutations (e.g., T139S, L141A, and Y180V as numbered with reference to SEQ ID NO:1) and at least 85% identity, at least 90% identity, or at least 95% identity to the sequence of SEQ ID NO:379. In some embodiments, clone CH3C.35.23.3 with the hole mutations and the sequence of SEQ ID NO:379.

In some embodiments, clone CH3C.35.23.3 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:380 or 381. In some embodiments, clone CH3C.35.23.3 with the hole mutations and the mutations that modulate effector function has the sequence of SEQ ID NO:380 or 381.

In some embodiments, clone CH3C.35.23.3 may have hole mutations (e.g., T139S, L141A, and Y180V as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:382. In some embodiments, clone CH3C.35.23.3 with the hole mutations and the mutations that increase serum stability has the sequence of SEQ ID NO:382.

In some embodiments, clone CH3C.35.23.3 may have hole mutations (e.g., T139S, L141A, and Y180V as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:502. In some embodiments, clone CH3C.35.23.3 with the hole mutations and the mutations that increase serum stability has the sequence of SEQ ID NO:502.

In some embodiments, clone CH3C.35.23.3 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:383 or 384. In some embodiments, clone CH3C.35.23.3 with the hole mutations, the mutations that modulate effector function, and the mutations that increase serum stability has the sequence of SEQ ID NO:383 or 384.

In some embodiments, clone CH3C.35.23.3 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:503 or 504. In some embodiments, clone CH3C.35.23.3 with the hole mutations, the mutations that modulate effector function, and the mutations that increase serum stability has the sequence of SEQ ID NO:503 or 504.

Clone CH3C.35.23.4

In some embodiments, clone CH3C.35.23.4 may have a knob mutation (e.g., T139W as numbered with reference to SEQ ID NO:1) and at least 85% identity, at least 90% identity, or at least 95% identity to the sequence of SEQ ID NO:385. In some embodiments, clone CH3C.35.23.4 with the knob mutation has the sequence of SEQ ID NO:385.

In some embodiments, clone CH3C.35.23.4 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:386 or 387. In some embodiments, clone CH3C.35.23.4 with the knob mutation and the mutations that modulate effector function has the sequence of SEQ ID NO:386 or 387.

In some embodiments, clone CH3C.35.23.4 may have a knob mutation (e.g., T139W as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:388. In some embodiments, clone CH3C.35.23.4 with the knob mutation and the mutations that increase serum stability has the sequence of SEQ ID NO:388.

In some embodiments, clone CH3C.35.23.4 may have a knob mutation (e.g., T139W as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:506. In some embodiments, clone CH3C.35.23.4 with the knob mutation and the mutations that increase serum stability has the sequence of SEQ ID NO:506.

In some embodiments, clone CH3C.35.23.4 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:389 or 390. In some embodiments, clone CH3C.35.23.4 with the knob mutation, the mutations that modulate effector function, and the mutations that increase serum stability has the sequence of SEQ ID NO:389 or 390.

In some embodiments, clone CH3C.35.23.4 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:507 or 508. In some embodiments, clone CH3C.35.23.4 with the knob mutation, the mutations that modulate effector function, and the mutations that increase serum stability has the sequence of SEQ ID NO:507 or 508.

In some embodiments, clone CH3C.35.23.4 may have hole mutations (e.g., T139S, L141A, and Y180V as numbered with reference to SEQ ID NO:1) and at least 85% identity, at least 90% identity, or at least 95% identity to the sequence of SEQ ID NO:391. In some embodiments, clone CH3C.35.23.4 with the hole mutations has the sequence of SEQ ID NO:391.

In some embodiments, clone CH3C.35.23.4 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:392 or 393. In some embodiments, clone CH3C.35.23.4 with the hole mutations and the mutations that modulate effector function has the sequence of SEQ ID NO:392 or 393.

In some embodiments, clone CH3C.35.23.4 may have hole mutations (e.g., T139S, L141A, and Y180V as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:394. In some embodiments, clone CH3C.35.23.4 with the hole mutations and the mutations that increase serum stability has the sequence of SEQ ID NO:394.

In some embodiments, clone CH3C.35.23.4 may have hole mutations (e.g., T139S, L141A, and Y180V as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:509. In some embodiments, clone CH3C.35.23.4 with the hole mutations and the mutations that increase serum stability has the sequence of SEQ ID NO:509.

In some embodiments, clone CH3C.35.23.4 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:395 or 396. In some embodiments, clone CH3C.35.23.4 with the hole mutations, the mutations that modulate effector function, and the mutations that increase serum stability has the sequence of SEQ ID NO:395 or 396.

In some embodiments, clone CH3C.35.23.4 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:510 or 511. In some embodiments, clone CH3C.35.23.4 with the hole mutations, the mutations that modulate effector function, and the mutations that increase serum stability has the sequence of SEQ ID NO:510 or 511.

Clone CH3C.35.21.17.2

In some embodiments, clone CH3C.35.21.17.2 may have a knob mutation (e.g., T139W as numbered with reference to SEQ ID NO:1) and at least 85% identity, at least 90% identity, or at least 95% identity to the sequence of SEQ ID NO:397. In some embodiments, clone CH3C.35.21.17.2 with the knob mutation has the sequence of SEQ ID NO:397.

In some embodiments, clone CH3C.35.21.17.2 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:398 or 399. In some embodiments, clone CH3C.35.21.17.2 with the knob mutation and the mutations that modulate effector function has the sequence of SEQ ID NO:398 or 399.

In some embodiments, clone CH3C.35.21.17.2 may have a knob mutation (e.g., T139W as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:400. In some embodiments, clone CH3C.35.21.17.2 with the knob mutation and the mutations that increase serum stability has the sequence of SEQ ID NO:400.

In some embodiments, clone CH3C.35.21.17.2 may have a knob mutation (e.g., T139W as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:513. In some embodiments, clone CH3C.35.21.17.2 with the knob mutation and the mutations that increase serum stability has the sequence of SEQ ID NO:513.

In some embodiments, clone CH3C.35.21.17.2 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:401 or 402. In some embodiments, clone CH3C.35.21.17.2 with the knob mutation, the mutations that modulate effector function, and the mutations that increase serum stability has the sequence of SEQ ID NO:401 or 402.

In some embodiments, clone CH3C.35.21.17.2 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:514 or 515. In some embodiments, clone CH3C.35.21.17.2 with the knob mutation, the mutations that modulate effector function, and the mutations that increase serum stability has the sequence of SEQ ID NO:514 or 515.

In some embodiments, clone CH3C.35.21.17.2 may have hole mutations (e.g., T139S, L141A, and Y180V as numbered with reference to SEQ ID NO:1) and at least 85% identity, at least 90% identity, or at least 95% identity to the sequence of SEQ ID NO:403. In some embodiments, clone CH3C.35.21.17.2 with the hole mutations has the sequence of SEQ ID NO:403.

In some embodiments, clone CH3C.35.21.17.2 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:404 or 405. In some embodiments, clone CH3C.35.21.17.2 with the hole mutations and the mutations that modulate effector function has the sequence of SEQ ID NO:404 or 405.

In some embodiments, clone CH3C.35.21.17.2 may have hole mutations (e.g., T139S, L141A, and Y180V as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:406. In some embodiments, clone CH3C.35.21.17.2 with the hole mutations and the mutations that increase serum stability has the sequence of SEQ ID NO:406.

In some embodiments, clone CH3C.35.21.17.2 may have hole mutations (e.g., T139S, L141A, and Y180V as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:516. In some embodiments, clone CH3C.35.21.17.2 with the hole mutations and the mutations that increase serum stability has the sequence of SEQ ID NO:516.

In some embodiments, clone CH3C.35.21.17.2 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:407 or 408. In some embodiments, clone CH3C.35.21.17.2 with the hole mutations, the mutations that modulate effector function, and the mutations that increase serum stability has the sequence of SEQ ID NO:407 or 408.

In some embodiments, clone CH3C.35.21.17.2 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:517 or 518. In some embodiments, clone CH3C.35.21.17.2 with the hole mutations, the mutations that modulate effector function, and the mutations that increase serum stability has the sequence of SEQ ID NO:517 or 518.

Clone CH3C.35.23

In some embodiments, clone CH3C.35.23 may have a knob mutation (e.g., T139W as numbered with reference to SEQ ID NO:1) and at least 85% identity, at least 90% identity, or at least 95% identity to the sequence of SEQ ID NO:409. In some embodiments, clone CH3C.35.23 with the knob mutation has the sequence of SEQ ID NO:409.

In some embodiments, clone CH3C.35.23 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:410 or 411. In some embodiments, clone CH3C.35.23 with the knob mutation and the mutations that modulate effector function has the sequence of SEQ ID NO:410 or 411.

In some embodiments, clone CH3C.35.23 may have a knob mutation (e.g., T139W as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:412. In some embodiments, clone CH3C.35.23 with the knob mutation and the mutations that increase serum stability has the sequence of SEQ ID NO:412.

In some embodiments, clone CH3C.35.23 may have a knob mutation (e.g., T139W as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:520. In some embodiments, clone CH3C.35.23 with the knob mutation and the mutations that increase serum stability has the sequence of SEQ ID NO:520.

In some embodiments, clone CH3C.35.23 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:413 or 414. In some embodiments, clone CH3C.35.23 with the knob mutation, the mutations that modulate effector function, and the mutations that increase serum stability has the sequence of SEQ ID NO:413 or 414.

In some embodiments, clone CH3C.35.23 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:521 or 522. In some embodiments, clone CH3C.35.23 with the knob mutation, the mutations that modulate effector function, and the mutations that increase serum stability has the sequence of SEQ ID NO:521 or 522.

In some embodiments, clone CH3C.35.23 may have hole mutations (e.g., T139S, L141A, and Y180V as numbered with reference to SEQ ID NO:1) and at least 85% identity, at least 90% identity, or at least 95% identity to the sequence of SEQ ID NO:415. In some embodiments, clone CH3C.35.23 with the hole mutations has the sequence of SEQ ID NO:415.

In some embodiments, clone CH3C.35.23 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:416 or 417. In some embodiments, clone CH3C.35.23 with the hole mutations and the mutations that modulate effector function has the sequence of SEQ ID NO:416 or 417.

In some embodiments, clone CH3C.35.23 may have hole mutations (e.g., T139S, L141A, and Y180V as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:418. In some embodiments, clone CH3C.35.23 with the hole mutations and the mutations that increase serum stability has the sequence of SEQ ID NO:418.

In some embodiments, clone CH3C.35.23 may have hole mutations (e.g., T139S, L141A, and Y180V as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:523. In some embodiments, clone CH3C.35.23 with the hole mutations and the mutations that increase serum stability has the sequence of SEQ ID NO:523.

In some embodiments, clone CH3C.35.23 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:419 or 420. In some embodiments, clone CH3C.35.23 with the hole mutations, the mutations that modulate effector function, and the mutations that increase serum stability has the sequence of SEQ ID NO:419 or 420.

In some embodiments, clone CH3C.35.23 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:524 or 525. In some embodiments, clone CH3C.35.23 with the hole mutations, the mutations that modulate effector function, and the mutations that increase serum stability has the sequence of SEQ ID NO:524 or 525.

Clone CH3C.35.21

In some embodiments, clone CH3C.35.21 may have a knob mutation (e.g., T139W as numbered with reference to SEQ ID NO:1) and at least 85% identity, at least 90% identity, or at least 95% identity to the sequence of SEQ ID NO:436. In some embodiments, clone CH3C.35.21 with the knob mutation has the sequence of SEQ ID NO:436.

In some embodiments, clone CH3C.35.21 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO: 437 or 438. In some embodiments, clone CH3C.35.21 with the knob mutation and the mutations that modulate effector function has the sequence of SEQ ID NO:437 or 438.

In some embodiments, clone CH3C.35.21 may have a knob mutation (e.g., T139W as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:439. In some embodiments, clone CH3C.35.21 with the knob mutation and the mutations that increase serum stability has the sequence of SEQ ID NO:439.

In some embodiments, clone CH3C.35.21 may have a knob mutation (e.g., T139W as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:527. In some embodiments, clone CH3C.35.21 with the knob mutation and the mutations that increase serum stability has the sequence of SEQ ID NO:527.

In some embodiments, clone CH3C.35.21 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:440 or 441. In some embodiments, clone CH3C.35.21 with the knob mutation, the mutations that modulate effector function, and the mutations that increase serum stability has the sequence of SEQ ID NO:440 or 441.

In some embodiments, clone CH3C.35.21 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:528 or 529. In some embodiments, clone CH3C.35.21 with the knob mutation, the mutations that modulate effector function, and the mutations that increase serum stability has the sequence of SEQ ID NO:528 or 529.

In some embodiments, clone CH3C.35.21 may have hole mutations (e.g., T139S, L141A, and Y180V as numbered with reference to SEQ ID NO:1) and at least 85% identity, at least 90% identity, or at least 95% identity to the sequence of SEQ ID NO:442. In some embodiments, clone CH3C.35.21 with the hole mutations has the sequence of SEQ ID NO:442.

In some embodiments, clone CH3C.35.21 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:443 or 444. In some embodiments, clone CH3C.35.21 with the hole mutations and the mutations that modulate effector function has the sequence of SEQ ID NO:443 or 444.

In some embodiments, clone CH3C.35.21 may have hole mutations (e.g., T139S, L141A, and Y180V as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO: 445. In some embodiments, clone CH3C.35.21 with the hole mutations and the mutations that increase serum stability has the sequence of SEQ ID NO:445.

In some embodiments, clone CH3C.35.21 may have hole mutations (e.g., T139S, L141A, and Y180V as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:530. In some embodiments, clone CH3C.35.21 with the hole mutations and the mutations that increase serum stability has the sequence of SEQ ID NO:530.

In some embodiments, clone CH3C.35.21 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:446 or 447. In some embodiments, clone CH3C.35.21 with the hole mutations, the mutations that modulate effector function, and the mutations that increase serum stability has the sequence of SEQ ID NO:446 or 447.

In some embodiments, clone CH3C.35.21 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:531 or 532. In some embodiments, clone CH3C.35.21 with the hole mutations, the mutations that modulate effector function, and the mutations that increase serum stability has the sequence of SEQ ID NO:531 or 532.

Clone CH3C.35.20.1.1

In some embodiments, clone CH3C.35.20.1.1 may have a knob mutation (e.g., T139W as numbered with reference to SEQ ID NO:1) and at least 85% identity, at least 90% identity, or at least 95% identity to the sequence of SEQ ID NO:448. In some embodiments, clone CH3C.35.20.1.1 with the knob mutation has the sequence of SEQ ID NO:448.

In some embodiments, clone CH3C.35.20.1.1 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:449 or 450. In some embodiments, clone CH3C.35.20.1.1 with the knob mutation and the mutations that modulate effector function has the sequence of SEQ ID NO:449 or 450.

In some embodiments, clone CH3C.35.20.1.1 may have a knob mutation (e.g., T139W as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:451. In some embodiments, clone CH3C.35.20.1.1 with the knob mutation and the mutations that increase serum stability has the sequence of SEQ ID NO:451.

In some embodiments, clone CH3C.35.20.1.1 may have a knob mutation (e.g., T139W as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:534. In some embodiments, clone CH3C.35.20.1.1 with the knob mutation and the mutations that increase serum stability has the sequence of SEQ ID NO:534.

In some embodiments, clone CH3C.35.20.1.1 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:452 or 453. In some embodiments, clone CH3C.35.20.1.1 with the knob mutation, the mutations that modulate effector function, and the mutations that increase serum stability has the sequence of SEQ ID NO:452 or 453.

In some embodiments, clone CH3C.35.20.1.1 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:535 or 536. In some embodiments, clone CH3C.35.20.1.1 with the knob mutation, the mutations that modulate effector function, and the mutations that increase serum stability has the sequence of SEQ ID NO:535 or 536.

In some embodiments, clone CH3C.35.20.1.1 may have hole mutations (e.g., T139S, L141A, and Y180V as numbered with reference to SEQ ID NO:1) and at least 85% identity, at least 90% identity, or at least 95% identity to the sequence of SEQ ID NO:454. In some embodiments, clone CH3C.35.20.1.1 with the hole mutations has the sequence of SEQ ID NO:454.

In some embodiments, clone CH3C.35.20.1.1 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:455 or 456. In some embodiments, clone CH3C.35.20.1.1 with the hole mutations and the mutations that modulate effector function has the sequence of SEQ ID NO:455 or 456.

In some embodiments, clone CH3C.35.20.1.1 may have hole mutations (e.g., T139S, L141A, and Y180V as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:457. In some embodiments, clone CH3C.35.20.1.1 with the hole mutations and the mutations that increase serum stability has the sequence of SEQ ID NO:457.

In some embodiments, clone CH3C.35.20.1.1 may have hole mutations (e.g., T139S, L141A, and Y180V as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:537. In some embodiments, clone CH3C.35.20.1.1 with the hole mutations and the mutations that increase serum stability has the sequence of SEQ ID NO:537.

In some embodiments, clone CH3C.35.20.1.1 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:458 or 459. In some embodiments, clone CH3C.35.20.1.1 with the hole mutations, the mutations that modulate effector function, and the mutations that increase serum stability has the sequence of SEQ ID NO:458 or 459.

In some embodiments, clone CH3C.35.20.1.1 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:538 or 539. In some embodiments, clone CH3C.35.20.1.1 with the hole mutations, the mutations that modulate effector function, and the mutations that increase serum stability has the sequence of SEQ ID NO:538 or 539.

Clone CH3C.35.23.2.1

In some embodiments, clone CH3C.35.23.2.1 may have a knob mutation (e.g., T139W as numbered with reference to SEQ ID NO:1) and at least 85% identity, at least 90% identity, or at least 95% identity to the sequence of SEQ ID NO:460. In some embodiments, clone CH3C.35.23.2.1 with the knob mutation has the sequence of SEQ ID NO:460.

In some embodiments, clone CH3C.35.23.2.1 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:461 or 462. In some embodiments, clone CH3C.35.23.2.1 with the knob mutation and the mutations that modulate effector function has the sequence of SEQ ID NO:461 or 462.

In some embodiments, clone CH3C.35.23.2.1 may have a knob mutation (e.g., T139W as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:463. In some embodiments, clone CH3C.35.23.2.1 with the knob mutation and the mutations that increase serum stability has the sequence of SEQ ID NO:463.

In some embodiments, clone CH3C.35.23.2.1 may have a knob mutation (e.g., T139W as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:541. In some embodiments, clone CH3C.35.23.2.1 with the knob mutation and the mutations that increase serum stability has the sequence of SEQ ID NO:541.

In some embodiments, clone CH3C.35.23.2.1 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:464 or 465. In some embodiments, clone CH3C.35.23.2.1 with the knob mutation, the mutations that modulate effector function, and the mutations that increase serum stability has the sequence of SEQ ID NO:464 or 465.

In some embodiments, clone CH3C.35.23.2.1 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:542 or 543. In some embodiments, clone CH3C.35.23.2.1 with the knob mutation, the mutations that modulate effector function, and the mutations that increase serum stability has the sequence of SEQ ID NO:542 or 543.

In some embodiments, clone CH3C.35.23.2.1 may have hole mutations (e.g., T139S, L141A, and Y180V as numbered with reference to SEQ ID NO:1) and at least 85% identity, at least 90% identity, or at least 95% identity to the sequence of SEQ ID NO:466. In some embodiments, clone CH3C.35.23.2.1 with the hole mutations has the sequence of SEQ ID NO:466.

In some embodiments, clone CH3C.35.23.2.1 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:467 or 468. In some embodiments, clone CH3C.35.23.2.1 with the hole mutations and the mutations that modulate effector function has the sequence of SEQ ID NO:467 or 468.

In some embodiments, clone CH3C.35.23.2.1 may have hole mutations (e.g., T139S, L141A, and Y180V as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:469. In some embodiments, clone CH3C.35.23.2.1 with the hole mutations and the mutations that increase serum stability has the sequence of SEQ ID NO:469.

In some embodiments, clone CH3C.35.23.2.1 may have hole mutations (e.g., T139S, L141A, and Y180V as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:544. In some embodiments, clone CH3C.35.23.2.1 with the hole mutations and the mutations that increase serum stability has the sequence of SEQ ID NO:544.

In some embodiments, clone CH3C.35.23.2.1 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:470 or 471. In some embodiments, clone CH3C.35.23.2.1 with the hole mutations, the mutations that modulate effector function, and the mutations that increase serum stability has the sequence of SEQ ID NO:470 or 471.

In some embodiments, clone CH3C.35.23.2.1 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:545 or 546. In some embodiments, clone CH3C.35.23.2.1 with the hole mutations, the mutations that modulate effector function, and the mutations that increase serum stability has the sequence of SEQ ID NO:545 or 546.

Clone CH3C.35.23.1.1

In some embodiments, clone CH3C.35.23.1.1 may have a knob mutation (e.g., T139W as numbered with reference to SEQ ID NO:1) and at least 85% identity, at least 90% identity, or at least 95% identity to the sequence of SEQ ID NO:472. In some embodiments, clone CH3C.35.23.1.1 with the knob mutation has the sequence of SEQ ID NO:472.

In some embodiments, clone CH3C.35.23.1.1 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:473 or 474. In some embodiments, clone CH3C.35.23.1.1 with the knob mutation and the mutations that modulate effector function has the sequence of SEQ ID NO:473 or 474.

In some embodiments, clone CH3C.35.23.1.1 may have a knob mutation (e.g., T139W as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:475. In some embodiments, clone CH3C.35.23.1.1 with the knob mutation and the mutations that increase serum stability has the sequence of SEQ ID NO:475.

In some embodiments, clone CH3C.35.23.1.1 may have a knob mutation (e.g., T139W as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:548. In some embodiments, clone CH3C.35.23.1.1 with the knob mutation and the mutations that increase serum stability has the sequence of SEQ ID NO:548.

In some embodiments, clone CH3C.35.23.1.1 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:476 or 477. In some embodiments, clone CH3C.35.23.1.1 with the knob mutation, the mutations that modulate effector function, and the mutations that increase serum stability has the sequence of SEQ ID NO:476 or 477.

In some embodiments, clone CH3C.35.23.1.1 may have a knob mutation (e.g., T139W as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:549 or 550. In some embodiments, clone CH3C.35.23.1.1 with the knob mutation, the mutations that modulate effector function, and the mutations that increase serum stability has the sequence of SEQ ID NO:549 or 550.

In some embodiments, clone CH3C.35.23.1.1 may have hole mutations (e.g., T139S, L141A, and Y180V as numbered with reference to SEQ ID NO:1) and at least 85% identity, at least 90% identity, or at least 95% identity to the sequence of SEQ ID NO:478. In some embodiments, clone CH3C.35.23.1.1 with the hole mutations has the sequence of SEQ ID NO:478.

In some embodiments, clone CH3C.35.23.1.1 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), and at least 85% identity, at least 90% identity, or at least 95% identity to the sequence of SEQ ID NO:479 or 480. In some embodiments, clone CH3C.35.23.1.1 with the hole mutations and the mutations that modulate effector function has the sequence of SEQ ID NO:479 or 480.

In some embodiments, clone CH3C.35.23.1.1 may have hole mutations (e.g., T139S, L141A, and Y180V as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:481. In some embodiments, clone CH3C.35.23.1.1 with the hole mutations and the mutations that increase serum stability has the sequence of SEQ ID NO:481.

In some embodiments, clone CH3C.35.23.1.1 may have hole mutations (e.g., T139S, L141A, and Y180V as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:551. In some embodiments, clone CH3C.35.23.1.1 with the hole mutations and the mutations that increase serum stability has the sequence of SEQ ID NO:551.

In some embodiments, clone CH3C.35.23.1.1 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., M25Y, S27T, and T29E as numbered with reference to SEQ ID NO:1), and at least 85% identity, at least 90% identity, or at least 95% identity to the sequence of SEQ ID NO:482 or 483. In some embodiments, clone CH3C.35.23.1.1 with the hole mutations, the mutations that modulate effector function, and the mutations that increase serum stability has the sequence of SEQ ID NO:482 or 483.

In some embodiments, clone CH3C.35.23.1.1 may have hole mutations (e.g., T139S, L141A, and Y180V as numbered with reference to SEQ ID NO:1), mutations that modulate effector function (e.g., L7A, L8A, and/or P102G (e.g., L7A and L8A) as numbered with reference to SEQ ID NO:1), mutations that increase serum stability (e.g., N207S with or without M201L as numbered with reference to SEQ ID NO:1), and at least 85% identity, at least 90% identity, or at least 95% identity to the sequence of SEQ ID NO:552 or 553. In some embodiments, clone CH3C.35.23.1.1 with the hole mutations, the mutations that modulate effector function, and the mutations that increase serum stability has the sequence of SEQ ID NO:552 or 553.

IV. Conjugates

In some embodiments, a transferrin receptor-binding polypeptide comprising a modified CH2 or CH3 domain in accordance with the invention is linked to an agent, e.g., an agent that is to be internalized into a cell and/or for transcytosis across an endothelium, such as the blood-brain barrier, via a linker. The linker may be any linker suitable for joining an agent to the polypeptide. In some embodiments, the linkage is enzymatically cleavable. In certain embodiments, the linkage is cleavable by an enzyme present in the central nervous system.

In some embodiments, the linker is a peptide linker. The peptide linker may be configured such that it allows for the rotation of the agent and the transferrin receptor-binding polypeptide relative to each other; and/or is resistant to digestion by proteases. In some embodiments, the linker may be a flexible linker, e.g., containing amino acids such as Gly, Asn, Ser, Thr, Ala, and the like. Such linkers are designed using known parameters. For example, the linker may have repeats, such as Gly-Ser repeats.

In various embodiments, the conjugates can be generated using well-known chemical cross-linking reagents and protocols. For example, there are a large number of chemical cross-linking agents that are known to those skilled in the art and useful for cross-linking the polypeptide with an agent of interest. For example, the cross-linking agents are heterobifunctional cross-linkers, which can be used to link molecules in a stepwise manner. Heterobifunctional cross-linkers provide the ability to design more specific coupling methods for conjugating proteins, thereby reducing the occurrences of unwanted side reactions such as homo-protein polymers. A wide variety of heterobifunctional cross-linkers are known in the art, including N-hydroxysuccinimide (NETS) or its water soluble analog N-hydroxysulfosuccinimide (sulfo-NHS), succinimidyl 4-(N-maleimidomethyl)cyclohexane-1-carboxylate (SMCC), m-maleimidobenzoyl-N-hydroxysuccinimide ester (MBS); N-succinimidyl (4-iodoacetyl) aminobenzoate (SIAB), succinimidyl 4-(p-maleimidophenyl)butyrate (SMPB), 1-ethyl-3-(3-dimethylaminopropyl)carbodiimide hydrochloride (EDC); 4-succinimidyloxycarbonyl-a-methyl-a-(2-pyridyldithio)-toluene (SMPT), N-succinimidyl 3-(2-pyridyldithio) propionate (SPDP), and succinimidyl 6-[3-(2-pyridyldithio) propionate]hexanoate (LC-SPDP). Those cross-linking agents having N-hydroxysuccinimide moieties can be obtained as the N-hydroxysulfosuccinimide analogs, which generally have greater water solubility. In addition, those cross-linking agents having disulfide bridges within the linking chain can be synthesized instead as the alkyl derivatives so as to reduce the amount of linker cleavage in vivo. In addition to the heterobifunctional cross-linkers, there exist a number of other cross-linking agents including homobifunctional and photoreactive cross-linkers. Disuccinimidyl subcrate (DSS), bismaleimidohexane (BMI-1) and dimethylpimelimidate.2HCl (DMP) are examples of useful homobifunctional cross-linking agents, and bis-[B-(4-azidosalicylamido)ethyl]disulfide (BASED) and N-succinimidyl-6(4'-azido-2'-nitrophenylamino)hexanoate (SANPAH) are examples of useful photoreactive cross-linkers.

The agent of interest may be a therapeutic agent, including a cytotoxic agent, a DNA or RNA molecule, a chemical moiety, and the like. In some embodiments, the agent may be a peptide or small molecule therapeutic or imaging agent. In some embodiments, the small molecule is less than 1000 Da, less than 750 Da, or less than 500 Da.

The agent of interest may be linked to the N-terminal or C-terminal region of the transferrin receptor-binding polypeptide, or attached to any region of the polypeptide, so long as the agent does not interfere with binding of the transferrin receptor-binding polypeptide to the transferrin receptor.

V. Methods of Engineering Fc Polypeptides to Bind Transferrin Receptor

In a further aspect, methods of engineering a CH2 or CH3 domain polypeptide to have a transferrin receptor binding specificity are provided. In some embodiments, modification of a CH3 domain polypeptide comprises substituting various amino acids in set (i) and/or set (ii) as described herein. In some embodiments, the method comprises modifying a polynucleotide that encodes the CH3 domain polypeptide to incorporate amino acid changes at three, four, five, six, seven, eight or all nine positions in CH3 domain set (i). In some embodiments, the method comprises modifying a polynucleotide that encodes the CH3 domain polypeptide to incorporate amino acid changes at three, four, five, six, seven, or all eight positions in CH3 domain set (ii). The amino acids introduced into the desired positions may be generated by randomization or partial randomization to generate a library of CH3 domain polypeptides with amino acid substitutions at the various positions of the set. In some embodiments, the CH3 domain polypeptide is mutated in the context of an Fc region, which may or may not contain part of, or all of, a full hinge region.

In one aspect, a CH3 domain is engineered to specifically bind to a transferrin receptor, by (a) modifying a polynucleotide that encodes the CH3 domain to have at least five amino acid substitutions at positions 153, 157, 159, 160, 161, 162, 163, 164, 165, 186, 187, 188, 189, 194, 197, or 199, as numbered with reference to amino acids 114-220 of SEQ ID NO:1; and (b) expressing and recovering a polypeptide comprising the modified CH3 domain. In some embodiments, the CH3 domain is modified to have at least 5 substitutions at positions 153, 157, 159, 160, 161, 162, 163, 164, 165, 186, 187, 188, 189, 194, 197, or 199 wherein the substitutions are selected from the following: Trp, Tyr, Leu, or Gln at position 153; Leu, Tyr, Met, or Val at position 157; Leu, Thr, His, or Pro at position 159; Val or an acidic amino acid at position 160; an aromatic amino acid, e.g., Trp, at position 161; Val, Ser, or Ala at position 162; Ser at position 163; Ser, Thr, Gln, or Phe at position 164; Gln, Phe, or His at position 165; Glu, Ala, Ser, Leu, Thr, or Pro at position 186; Arg, Gly or Pro at position 187; Glu at position 188; Thr or an acidic amino acid at position 189; Trp, Tyr, His or Phe at position 194; Thr, Glu or Lys at position 197; and Trp or Gly at position 199.

In another aspect, a CH3 domain is engineered to specifically bind to a transferrin receptor, by (a) modifying a polynucleotide that encodes the CH3 domain to have at least five amino acid substitutions at positions 118, 119, 120, 122, 210, 211, 212, and 213, as numbered with reference to amino acids 114-220 of SEQ ID NO:1; and (b) expressing and recovering a polypeptide comprising the modified CH3 domain. In some embodiments, the CH3 domain is modified to have at least 5 substitutions at positions 118, 119, 120, 122, 210, 211, 212, and 213, wherein the substitutions are selected from the following: Phe or Ile at position 118; Asp, Glu, Gly, Ala, or Lys at position 119; Tyr, Met, Leu, Ile, or Asp at position 120; Thr or Ala at position 122; Gly at position 210; Phe at position 211; at position 212; and Asp at positon 213.

CH2 domain polypeptides may be similarly engineered for transferrin receptor binding by introducing mutations in anywhere from three to all of the positions of a CH2 domain set (iii), set (iv), set (v), or set (vi). Thus, in some embodiments, modification of a CH2 domain polypeptide comprises substituting various amino acids in set (iii), set (iv), set (v), and/or set (vi) as described herein. In some embodiments, the method comprises modifying a polynucleotide that encodes the CH2 domain polypeptide to incorporate amino acid changes at three, four, five, six, seven, eight or all nine positions in CH2 domain set (iii). In some embodiments, the method comprises modifying a polynucleotide that encodes the CH2 domain polypeptide to incorporate amino acid changes at three, four, five, six, seven, eight, nine, or all ten positions in CH2 domain set (iv). In some embodiments, the method comprises modifying a polynucleotide that encodes the CH2 domain polypeptide to incorporate amino acid changes at three, four, five, six, seven, eight, nine, or all ten positions in CH2 domain set (v). In some embodiments, the method comprises modifying a polynucleotide that encodes the CH2 domain polypeptide to incorporate amino acid changes at three, four, five, six, seven, eight or all nine positions in CH2 domain set (vi). The amino acids introduced into the desired positions may be generated by randomization or partial randomization to generate a library of CH2 domain polypeptides with amino acid substitutions at the various positions of the set. In some embodiments, the CH2 domain polypeptide is mutated in the context of an Fc region, which may or may not contain part of, or all of, a full hinge region.

In one aspect, a CH2 domain is engineered to specifically bind to a transferrin receptor, by (a) modifying a polynucleotide that encodes the CH2 domain to have at least five amino acid substitutions at positions 47, 49, 56, 58, 59, 60, 61, 62, and 63, as numbered with reference to amino acids 4-113 of SEQ ID NO:1; and (b) expressing and recovering a polypeptide comprising the modified CH2 domain. In some embodiments, the CH2 domain is modified to have at least 5 substitutions at positions 47, 49, 56, 58, 59, 60, 61, 62, and 63, wherein the substitutions are selected from the following: Glu, Gly, Gln, Ser, Ala, Asn, Tyr, or Trp at position 47; Ile, Val, Asp, Glu, Thr, Ala, or Tyr at position 49; Asp, Pro, Met, Leu, Ala, Asn, or Phe at position 56; Arg, Ser, Ala, or Gly at position 58; Tyr, Trp, Arg, or Val at position 59; Glu at position 60; Trp or Tyr at position 61; Gln, Tyr, His, Ile, Phe, Val, or Asp at position 62; and Leu, Trp, Arg, Asn, Tyr, or Val at position 63.

In another aspect, a CH2 domain is engineered to specifically bind to a transferrin receptor, by (a) modifying a polynucleotide that encodes the CH2 domain to have at least five amino acid substitutions at positions 39, 40, 41, 42, 43, 44, 68, 70, 71, and 72, as numbered with reference to amino acids 4-113 of SEQ ID NO:1; and (b) expressing and recovering a polypeptide comprising the modified CH2 domain. In some embodiments, the CH2 domain is modified to have at least 5 substitutions at positions 39, 40, 41, 42, 43, 44, 68, 70, 71, and 72, wherein the substitutions are selected from the following: Pro, Phe, Ala, Met, or Asp at position 39; Gln, Pro, Arg, Lys, Ala, Ile, Leu, Glu, Asp, or Tyr at position 40; Thr, Ser, Gly, Met, Val, Phe, Trp, or Leu at position 41; Pro, Val, Ala, Thr, or Asp at position 42; Pro, Val, or Phe at position 43; Trp, Gln, Thr, or Glu at position 44; Glu, Val, Thr, Leu, or Trp at position 68; Tyr, His, Val, or Asp at position 70; position 71 is Thr, His, Gln, Arg, Asn, or Val at position 71; and position 72 is Tyr, Asn, Asp, Ser, or Pro.

In a further aspect, a CH2 domain is engineered to specifically bind to a transferrin receptor, by (a) modifying a polynucleotide that encodes the CH2 domain to have at least five amino acid substitutions at positions 41, 42, 43, 44, 45, 65, 66, 67, 69, and 73, as numbered with reference to amino acids 4-113 of SEQ ID NO:1; and (b) expressing and recovering a polypeptide comprising the modified CH2 domain. In some embodiments, the CH2 domain is modified to have at least 5 substitutions at positions 41, 42, 43, 44, 45, 65, 66, 67, 69, and 73, wherein the substitutions are selected from the following: Val or Asp at position 41; Pro, Met, or Asp at position 42; Pro or Trp at position 43; Arg, Trp, Glu, or Thr at position 44; Met, Tyr, or Trp at position 45; Leu or Trp at position 65; Thr, Val, Ile, or Lys at position 66; Ser, Lys, Ala, or Leu at position 67; His, Leu, or Pro at position 69; and Val or Trp at position 73.

In another aspect, a CH2 domain is engineered to specifically bind to a transferrin receptor, by (a) modifying a polynucleotide that encodes the CH2 domain to have at least five amino acid substitutions at positions 45, 47, 49, 95, 97, 99, 102, 103, and 104, as numbered with reference to amino acids 4-113 of SEQ ID NO:1; and (b) expressing and recovering a polypeptide comprising the modified CH2 domain. In some embodiments, the CH2 domain is modified to have at least 5 substitutions at positions 45, 47, 49, 95, 97, 99, 102, 103, and 104, wherein the substitutions are selected from the following: Trp, Val, Ile, or Ala at position 45; Trp or Gly at position 47; Tyr, Arg, or Glu at position 49; Ser, Arg, or Gln at position 95; Val, Ser, or Phe at position 97; Ile, Ser, or Trp at position 99; Trp, Thr, Ser, Arg, or Asp at position 102; Trp at position 103; and Ser, Lys, Arg, or Val at position 104.

Polypeptides comprising the mutated CH3 and/or CH2 domains may be expressed using any number of systems. For example, in some embodiments, mutant polypeptides are expressed in a display system. In other illustrative embodiments, mutant polypeptides are expressed as soluble polypeptides that are secreted from the host cell. In some embodiments, the expression system is a display system, e.g., a viral display system, a cell surface display system such as a yeast display system, an mRNA display system, or a polysomal display system. The library is screened using known methodology to identify transferrin receptor binders, which may be further characterized to determine binding kinetics. Additional mutations may then be introduced into selected clones, either at positions in the initial set of amino acids (set (i) or set (ii)); or at other positions outside of the set that are also present in the binding region of the selected clone.

VI. Nucleic Acids, Vectors, and Host Cells

Modified transferrin receptor-binding polypeptides as described herein are typically prepared using recombinant methods. Accordingly, in some aspects, the invention provides isolated nucleic acids comprising a nucleic acid sequence encoding any of the polypeptides comprising polypeptides as described herein, and host cells into which the nucleic acids are introduced that are used to replicate the polypeptide-encoding nucleic acids and/or to express the polypeptides. In some embodiments, the host cell is eukaryotic, e.g., a human cell.

In another aspect, polynucleotides are provided that comprise a nucleotide sequence that encodes the polypeptides described herein. The polynucleotides may be single-stranded or double-stranded. In some embodiments, the polynucleotide is DNA. In particular embodiments, the polynucleotide is cDNA. In some embodiments, the polynucleotide is RNA.

In some embodiments, the polynucleotide is included within a nucleic acid construct. In some embodiments, the construct is a replicable vector. In some embodiments, the vector is selected from a plasmid, a viral vector, a phagemid, a yeast chromosomal vector, and a non-episomal mammalian vector.

In some embodiments, the polynucleotide is operably linked to one or more regulatory nucleotide sequences in an expression construct. In one series of embodiments, the nucleic acid expression constructs are adapted for use as a surface expression library. In some embodiments, the library is adapted for surface expression in yeast. In some embodiments, the library is adapted for surface expression in phage. In another series of embodiments, the nucleic acid expression constructs are adapted for expression of the polypeptide in a system that permits isolation of the polypeptide in milligram or gram quantities. In some embodiments, the system is a mammalian cell expression system. In some embodiments, the system is a yeast cell expression system.

Expression vehicles for production of a recombinant polypeptide include plasmids and other vectors. For instance, suitable vectors include plasmids of the following types: pBR322-derived plasmids, pEMBL-derived plasmids, pEX-derived plasmids, pBTac-derived plasmids, and pUC-derived plasmids for expression in prokaryotic cells, such as E. coli. The pcDNAI/amp, pcDNAI/neo, pRc/CMV, pSV2gpt, pSV2neo, pSV2-dhfr, pTk2, pRSVneo, pMSG, pSVT7, pko-neo, and pHyg-derived vectors are examples of mammalian expression vectors suitable for transfection of eukaryotic cells. Alternatively, derivatives of viruses such as the bovine papilloma virus (BPV-1), or Epstein-Barr virus (pHEBo, pREP-derived, and p205) can be used for transient expression of polypeptides in eukaryotic cells. In some embodiments, it may be desirable to express the recombinant polypeptide by the use of a baculovirus expression system. Examples of such baculovirus expression systems include pVL-derived vectors (such as pVL1392, pVL1393, and pVL941), pAcUW-derived vectors (such as pAcUW1), and pBlueBac-derived vectors. Additional expression systems include adenoviral, adeno-associated virus, and other viral expression systems.

Vectors may be transformed into any suitable host cell. In some embodiments, the host cells, e.g., bacteria or yeast cells, may be adapted for use as a surface expression library. In some cells, the vectors are expressed in host cells to express relatively large quantities of the polypeptide. Such host cells include mammalian cells, yeast cells, insect cells, and prokaryotic cells. In some embodiments, the cells are mammalian cells, such as Chinese Hamster Ovary (CHO) cell, baby hamster kidney (BHK) cell, NS0 cell, Y0 cell, HEK293 cell, COS cell, Vero cell, or HeLa cell.

A host cell transfected with an expression vector encoding a transferrin receptor-binding polypeptide can be cultured under appropriate conditions to allow expression of the polypeptide to occur. The polypeptides may be secreted and isolated from a mixture of cells and medium containing the polypeptides. Alternatively, the polypeptide may be retained in the cytoplasm or in a membrane fraction and the cells harvested, lysed, and the polypeptide isolated using a desired method.

VII. Therapeutic Methods

A transferrin receptor-binding polypeptide in accordance with the invention may be used therapeutically in many indications. In some embodiments, the transferrin receptor-binding polypeptide is used to deliver a therapeutic agent to a target cell type that expresses the transferrin receptor. In some embodiments, a transferrin receptor-binding polypeptide may be used to transport a therapeutic moiety across an endothelium, e.g., the blood-brain barrier, to be taken up by the brain.

In some embodiments, a transferrin receptor-binding polypeptide of the present invention may be used, e.g., conjugated to a therapeutic agent, to deliver the therapeutic agent to treat a neurological disorder such as a disease of the brain or central nervous system (CNS). Illustrative diseases include Alzheimer's Disease, Parkinson's disease, amyotrophic lateral sclerosis, frontotemporal dementia, vascular dementia, Lewy body dementia, Pick's disease, primary age-related tauopathy, or progressive supranuclear palsy. In some embodiments, the disease may be a tauopathy, a prion disease (such as bovine spongiform encephalopathy, scrapie, Creutzfeldt-Jakob syndrome, kuru, Gerstmann-Straussler-Scheinker disease, chronic wasting disease, and fatal familial insomnia), bulbar palsy, motor neuron disease, or a nervous system heterodegenerative disorders (such as Canavan disease, Huntington's disease, neuronal ceroid-lipofuscinosis, Alexander's disease, Tourette's syndrome, Menkes kinky hair syndrome, Cockayne syndrome, Halervorden-Spatz syndrome, lafora disease, Rett syndrome, hepatolenticular degeneration, Lesch-Nyhan syndrome, Friedreich's ataxia, Spinal muscular atrophy, and Unverricht-Lundborg syndrome). In some embodiments, the disease is stroke or multiple sclerosis. In some embodiments, the patient may be asymptomatic, but has a marker that is associated with the disease of the brain or CNS. In some embodiments, the use of a transferrin receptor-binding polypeptide of the present invention in the manufacture of a medicament for treating a neurological disorder is provided.

In some embodiments, a transferrin receptor-binding polypeptide of the present invention is used for the treatment of cancer. In certain embodiments, the cancer is a primary cancer of the CNS, such as glioma, glioblastoma multiforme, meningioma, astrocytoma, acoustic neuroma, chondroma, oligodendroglioma, medulloblastomas, ganglioglioma, Schwannoma, neurofibroma, neuroblastoma, or extradural, intramedullary or intradural tumors. In some embodiments, the cancer is a solid tumor, or in other embodiments, the cancer is a non-solid tumor. Solid-tumor cancers include tumors of the central nervous system, breast cancer, prostate cancer, skin cancer (including basal cell carcinoma, cell carcinoma, squamous cell carcinoma and melanoma), cervical cancer, uterine cancer, lung cancer, ovarian cancer, testicular cancer, thyroid cancer, astrocytoma, glioma, pancreatic cancer, mesotheliomas, gastric cancer, liver cancer, colon cancer, rectal cancer, renal cancer including nephroblastoma, bladder cancer, oesophageal cancer, cancer of the larynx, cancer of the parotid, cancer of the biliary tract, endometrial cancer, adenocarcinomas, small cell carcinomas, neuroblastomas, adrenocortical carcinomas, epithelial carcinomas, desmoid tumors, desmoplastic small round cell tumors, endocrine tumors, Ewing sarcoma family tumors, germ cell tumors, hepatoblastomas, hepatocellular carcinomas, non-rhabdomyosarcome soft tissue sarcomas, osteosarcomas, peripheral primitive neuroectodermal tumors, retinoblastomas, and rhabdomyosarcomas. In some embodiments, the use of a transferrin receptor-binding polypeptide of the present invention in the manufacture of a medicament for treating cancer is provided.

In some embodiments, a transferrin receptor-binding polypeptide of the present invention may be used in the treatment of an autoimmune or inflammatory disease. Examples of such diseases include, but are not limited to, ankylosing spondylitis, arthritis, osteoarthritis, rheumatoid arthritis, psoriatic arthritis, asthma, scleroderma, stroke, atherosclerosis, Crohn's disease, colitis, ulcerative colitis, dermatitis, diverticulitis, fibrosis, idiopathic pulmonary fibrosis, fibromyalgia, hepatitis, irritable bowel syndrome (IBS), lupus, systemic lupus erythematous (SLE), nephritis, multiple sclerosis, and ulcerative colitis. In some embodiments, the use of a transferrin receptor-binding polypeptide of the present invention in the manufacture of a medicament for treating an autoimmune or inflammatory disease is provided.

In some embodiments, a transferrin receptor-binding polypeptide of the present invention may be used in the treatment of a cardiovascular disease, such as coronary artery disease, heart attack, abnormal heart rhythms or arrhythmias, heart failure, heart valve disease, congenital heart disease, heart muscle disease, cardiomyopathy, pericardial disease, aorta disease, marfan syndrome, vascular disease, and blood vessel disease. In some embodiments, the use of a transferrin receptor-binding polypeptide of the present invention in the manufacture of a medicament for treating a cardiovascular disease is provided.

In some embodiments, the method further comprises administering to the subject one or more additional therapeutic agents. For example, in some embodiments for treating a disease of the brain or central nervous system, the method may comprise administering to the subject a neuroprotective agent, e.g., an anticholinergic agent, a dopaminergic agent, a glutamatergic agent, a histone deacetylase (HDAC) inhibitor, a cannabinoid, a caspase inhibitor, melatonin, an anti-inflammatory agent, a hormone (e.g., estrogen or progesterone), or a vitamin. In some embodiments, the method comprises administering to the subject an agent for use in treating a cognitive or behavioral symptom of a neurological disorder (e.g., an antidepressant, a dopamine agonist, or an anti-psychotic).

A transferrin receptor-binding polypeptide of the present invention is administered to a subject at a therapeutically effective amount or dose. Illustrative dosages include a daily dose range of about 0.01 mg/kg to about 500 mg/kg, or about 0.1 mg/kg to about 200 mg/kg, or about 1 mg/kg to about 100 mg/kg, or about 10 mg/kg to about 50 mg/kg, can be used. The dosages, however, may be varied according to several factors, including the chosen route of administration, the formulation of the composition, patient response, the severity of the condition, the subject's weight, and the judgment of the prescribing physician. The dosage can be increased or decreased over time, as required by an individual patient. In some embodiments, a patient initially is given a low dose, which is then increased to an efficacious dosage tolerable to the patient. Determination of an effective amount is well within the capability of those skilled in the art.

In various embodiments, a transferrin receptor-binding polypeptide of the present invention is administered parenterally. In some embodiments, the polypeptide is administered intravenously. Intravenous administration can be by infusion, e.g., over a period of from about 10 to about 30 minutes, or over a period of at least 1 hour, 2 hours, or 3 hours. In some embodiments, the polypeptide is administered as an intravenous bolus. Combinations of infusion and bolus administration may also be used.

In some parenteral embodiments, a transferrin receptor-binding polypeptide is administered intraperiotneally, subcutaneously, intradermally, or intramuscularly. In some embodiments, the polypeptide is administered intradermally or intramuscularly. In some embodiments, the polypeptide is administered intrathecally, such as by epidural administration, or intracerebroventricularly.

In other embodiments, a transferrin receptor-binding polypeptide may be administered orally, by pulmonary administration, intranasal administration, intraocular administration, or by topical administration. Pulmonary administration can also be employed, e.g., by use of an inhaler or nebulizer, and formulation with an aerosolizing agent.

VIII. Pharmaceutical Compositions and Kits

In another aspect, pharmaceutical compositions and kits comprising a transferrin receptor-binding polypeptide in accordance with the invention are provided.

Pharmaceutical Compositions

Guidance for preparing formulations for use in the present invention can be found in any number of handbooks for pharmaceutical preparation and formulation that are known to those of skill in to art.

In some embodiments, a pharmaceutical composition comprises a transferrin receptor-binding polypeptide as described herein and further comprises one or more pharmaceutically acceptable carriers and/or excipients. A pharmaceutically acceptable carrier includes any solvents, dispersion media, or coatings that are physiologically compatible and that preferably does not interfere with or otherwise inhibit the activity of the active agent. Various pharmaceutically acceptable excipients are well-known.

In some embodiments, the carrier is suitable for intravenous, intrathecal, intracerebroventricular, intramuscular, oral, intraperitoneal, transdermal, topical, or subcutaneous administration. Pharmaceutically acceptable carriers can contain one or more physiologically acceptable compounds that act, for example, to stabilize the composition or to increase or decrease the absorption of the polypeptide. Physiologically acceptable compounds can include, for example, carbohydrates, such as glucose, sucrose, or dextrans, antioxidants, such as ascorbic acid or glutathione, chelating agents, low molecular weight proteins, compositions that reduce the clearance or hydrolysis of the active agents, or excipients or other stabilizers and/or buffers. Other pharmaceutically acceptable carriers and their formulations are also available in the art.

The pharmaceutical compositions described herein can be manufactured in a manner that is known to those of skill in the art, e.g., by means of conventional mixing, dissolving, granulating, dragee-making, emulsifying, encapsulating, entrapping, or lyophilizing processes. The following methods and excipients are merely exemplary and are in no way limiting.

For oral administration, a transferrin receptor-binding polypeptide can be formulated by combining it with pharmaceutically acceptable carriers that are well-known in the art. Such carriers enable the compounds to be formulated as tablets, pills, dragees, capsules, emulsions, lipophilic and hydrophilic suspensions, liquids, gels, syrups, slurries, suspensions and the like, for oral ingestion by a patient to be treated. Pharmaceutical preparations for oral use can be obtained by mixing the polypeptides with a solid excipient, optionally grinding a resulting mixture, and processing the mixture of granules, after adding suitable auxiliaries, if desired, to obtain tablets or dragee cores. Suitable excipients include, for example, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carboxymethylcellulose, and/or polyvinylpyrrolidone. If desired, disintegrating agents can be added, such as a cross-linked polyvinyl pyrrolidone, agar, or alginic acid or a salt thereof such as sodium alginate.

As disclosed above, a transferrin receptor-binding polypeptide as described herein can be formulated for parenteral administration by injection, e.g., by bolus injection or continuous infusion. For injection, the polypeptides can be formulated into preparations by dissolving, suspending, or emulsifying them in an aqueous or nonaqueous solvent, such as vegetable or other similar oils, synthetic aliphatic acid glycerides, esters of higher aliphatic acids or propylene glycol; and if desired, with conventional additives such as solubilizers, isotonic agents, suspending agents, emulsifying agents, stabilizers, and preservatives. In some embodiments, polypeptides can be formulated in aqueous solutions, preferably in physiologically compatible buffers such as Hanks's solution, Ringer's solution, or physiological saline buffer. Formulations for injection can be presented in unit dosage form, e.g., in ampules or in multi-dose containers, with an added preservative. The compositions can take such forms as suspensions, solutions, or emulsions in oily or aqueous vehicles, and can contain formulatory agents such as suspending, stabilizing, and/or dispersing agents.

In some embodiments, a transferrin receptor-binding polypeptide is prepared for delivery in a sustained-release, controlled release, extended-release, timed-release, or delayed-release formulation, for example, in semi-permeable matrices of solid hydrophobic polymers containing the active agent. Various types of sustained-release materials have been established and are well-known by those skilled in the art. Extended-release formulations include film-coated tablets, multiparticulate or pellet systems, matrix technologies using hydrophilic or lipophilic materials and wax-based tablets with pore-forming excipients. Sustained-release delivery systems can, depending on their design, release the compounds over the course of hours or days, for instance, over 4, 6, 8, 10, 12, 16, 20, 24 hours or more. Usually, sustained release formulations can be prepared using naturally occurring or synthetic polymers, for instance, polymeric vinyl pyrrolidones, such as polyvinyl pyrrolidone; carboxyvinyl hydrophilic polymers; hydrophobic and/or hydrophilic hydrocolloids, such as methylcellulose, ethylcellulose, hydroxypropylcellulose, and hydroxypropylmethylcellulose; and carboxypolymethylene.

Typically, a pharmaceutical composition for use in in vivo administration is sterile. Sterilization can be accomplished according to methods known in the art, e.g., heat sterilization, steam sterilization, sterile filtration, or irradiation.

Dosages and desired drug concentration of pharmaceutical compositions of the invention may vary depending on the particular use envisioned. The determination of the appropriate dosage or route of administration is well within the skill of one in the art. Suitable dosages are also described in Section VII above.

Kits

In some embodiments, kits comprising a transferrin receptor-binding polypeptide as described herein are provided. In some embodiments, the kits are for use in preventing or treating a neurological disorder such as a disease of the brain or central nervous system (CNS).

In some embodiments, the kit further comprises one or more additional therapeutic agents. For example, in some embodiments, the kit comprises a transferrin receptor-binding polypeptide as described herein and further comprises one or more additional therapeutic agents for use in the treatment of a neurological disorder. In some embodiments, the kit further comprises instructional materials containing directions (i.e., protocols) for the practice of the methods described herein (e.g., instructions for using the kit for administering a composition across the blood-brain barrier). While the instructional materials typically comprise written or printed materials, they are not limited to such. Any medium capable of storing such instructions and communicating them to an end user is contemplated by this invention. Such media include, but are not limited to, electronic storage media (e.g., magnetic discs, tapes, cartridges, chips), optical media (e.g., CD-ROM), and the like. Such media may include addresses to internet sites that provide such instructional materials.

IX. Examples

The present invention will be described in greater detail by way of specific examples. The following examples are offered for illustrative purposes only, and are not intended to limit the invention in any manner. Those of skill in the art will readily recognize a variety of noncritical parameters which can be changed or modified to yield essentially the same results. Efforts have been made to ensure accuracy with respect to numbers used (e.g., amounts, temperatures, etc.), but some experimental error and deviation may be present. The practice of the present invention will employ, unless otherwise indicated, conventional methods of protein chemistry, biochemistry, recombinant DNA techniques and pharmacology, within the skill of the art. Such techniques are explained fully in the literature. Additionally, it should be apparent to one of skill in the art that the methods for engineering as applied to certain libraries can also be applied to other libraries described herein.

Example 1

Generation of TfR Target

DNA encoding the transferrin receptor (TfR) ectodomain (ECD) (residues 121-760 of the human (SEQ ID NO:235) or cyno (SEQ ID NO:300) TfR) was cloned into a mammalian expression vector with C-terminal cleavable His- and Avi-tags. The plasmid was transfected and expressed in HEK293 cells. The ectodomain was purified from the harvested supernatant using Ni-NTA chromatography followed by size-exclusion chromatography to remove any aggregated protein. The yield was about 5 mg per liter of culture. The protein was stored in 10 mM $K_3PO_4$ (pH 6.7), 100 mM KCl, 100 mM NaCl, and 20% glycerol and frozen at –20° C.

DNA encoding the permutated TfR apical domain (SEQ ID NO:301) (residues 326-379 and 194-296 of the human or cyno TfR) was cloned into a pET28 vector with an N-terminal His-tag for purification and an Avi-tag for in vivo biotinylation. The plasmid was co-transformed with a BirA expression vector into BL21 (DE3) cells. Cells were grown in LB media at 37° C. until log phase, and then induced with 1 mM isopropyl 1-thio-β-D-galactopyranoside (IPTG) followed by culture overnight at 18° C. The cells were lysed and the soluble fraction was applied to an Ni-NTA column for affinity purification followed by size-exclusion chromatography to remove any aggregated protein. The yield was about 10 mg per liter of culture. The protein was stored in 50 mM HEPES (pH 7.5), 150 mM NaCl, and 1 mM DTT and frozen at –20° C.

The purified TfR ECDs were biotinylated using an EZ-link sulfo-NHS-LC-Biotin kit (obtained from Thermo Scientific). Five-fold molar excess of biotin was used for the reaction. The excess biotin was removed by extensively dialyzing against PBS.

The Avi-tagged TfR ECDs and apical domains was biotinylated using BirA-500 (BirA biotin-protein ligase standard reaction kit from Avidity, LLC). After reaction, the labeled proteins were further purified by size-exclusion chromatography to remove excess BirA enzyme. The final material was stored in 10 mM $K_3PO_4$ (pH 6.7), 100 mM KCl, 100 mM NaCl, and 20% glycerol and frozen at –20° C.

Example 2

Design and Characterization of Engineered Transferrin Receptor Binding Polypeptides This example describes the design, generation, and characterization of polypeptides of the present invention. For the purposes of this example and comparing the amino acids that are the same in clone sequences, a "conserved" mutation is considered to be one that occurred in all of the identified clones (not a conservative amino acid substitution), while a "semi-conserved" mutation is one that occurs in >50% of clones.

Unless otherwise indicated, the positions of amino acid residues in this section are numbered based on SEQ ID NO:1, a human IgG1 wild-type Fc region having three residues from the hinge, PCP, at the amino-terminal end.

Design of Polypeptide Fc Region Domain Libraries

New molecular recognition was engineered into polypeptide Fc regions by selecting certain solvent exposed surface patches for modification, constructing surface display libraries in which the amino acid composition of the selected patch was altered by randomization and then screening the surface-displayed sequence variants for desired functionality using standard expression display techniques. As used herein, the term "randomization" includes partial randomization as well as sequence changes with pre-defined nucleotide or amino acid mixing ratios. Typical surface-exposed patches selected for randomization had areas between about 600 to 1500 $Å^2$, and comprised about 7 to 15 amino acids.

Clone Registers

The following registers were designed and generated according to the methods described herein. As used herein, the term "register" refers to a series of surface-exposed amino acid residues that form a contiguous surface that can be altered (e.g., by the introduction of mutations into the peptide coding gene sequences to produce amino acid substitutions, insertions, and/or deletions at the positions listed in the registers).

CH2 Register A2—Set (iii)

The CH2A2 register (Table 1) included amino acid positions 47, 49, 56, 58, 59, 60, 61, 62, and 63 as numbered with reference to the human IgG1 Fc region amino acid sequence set forth in SEQ ID NO:1. The CH2A2 register was designed to form a surface along a beta sheet, an adjacent turn, and a following loop. It is well removed from both the FcγR and FcRn binding sites.

CH2 register C—Set (iv)

The CH2C register (Table 2) included amino acid positions 39, 40, 41, 42, 43, 44, 68, 70, 71, and 72 as numbered with reference to the human IgG1 Fc region amino acid sequence set forth in SEQ ID NO:1. The CH2C register utilizes solvent-exposed residues along a series of loops near the hinge and very close to the FcγR binding site of the CH2 region.

CH2 register D—Set (v)

The CH2D register (Table 3) included amino acid positions 41, 42, 43, 44, 45, 65, 66, 66, 69, and 73 as numbered with reference to the human IgG1 Fc region amino acid sequence set forth in SEQ ID NO:1. The CH2D register, similar to CH2C, utilizes solvent-posed residues along a series of loops at the top of the CH2 region, very close to the FcγR binding site. The CH2C and CH2D registers largely share one loop and differ in the second loop utilized for binding.

CH2 register E3—Set (vi)

The CH2E3 register (Table 4) included amino acid positions 45, 47, 49, 95, 97, 99, 102, 103, and 104 as numbered with reference to the human IgG1 Fc region amino acid sequence set forth in SEQ ID NO:1. The CH2E3 register positions are also close to the FcγR binding site, but utilize solvent-exposed residues on beta sheets that are adjacent to the loops near the FcγR binding site, in addition to some of the loop residues.

CH3 register B—Set (ii)

The CH3B register (Table 5) included amino acid positions 118, 119, 120, 122, 210, 211, 212, and 213 as numbered with reference to the human IgG1 Fc region amino acid sequence set forth in SEQ ID NO:1. The CH3B register is largely made up of solvent-exposed residues on two parallel beta sheets along with several less-structured residues near the C-terminus of the CH3 region. It is distant from the FcγR and FcRn binding sites.

CH3 register C—Set (i)

The CH3C register (Table 6) included amino acid positions 157, 159, 160, 161, 162, 163, 186, 189, and 194 as numbered with reference to the human IgG1 Fc region amino acid sequence set forth in SEQ ID NO:1. The CH3C register positions form a contiguous surface by including surface-exposed residues from two loops, both distant from the FcγR and FcRn binding sites.

Generation of Phage-Display Libraries

A DNA template coding for the wild-type human Fc sequence (SEQ ID NO:1) was synthesized and incorporated into a phagemid vector. The phagemid vector contained an ompA or pelB leader sequence, the Fc insert fused to c-Myc and 6×His epitope tags, and an amber stop codon followed by M13 coat protein pIII.

Primers containing "NNK" tricodons at the corresponding positions for randomization were generated, where N is any DNA base (i.e., A, C, G, or T) and K is either G or T. Alternatively, primers for "soft" randomization were used, where a mix of bases corresponding to 70% wild-type base and 10% of each of the other three bases was used for each randomization position. Libraries were generated by performing PCR amplification of fragments of the Fc region corresponding to regions of randomization and then assembled using end primers containing SfiI restriction sites, then digested with SfiI and ligated into the phagemid vectors. Alternatively, the primers were used to conduct Kunkel mutagenesis. Methods of performing Kunkel mutagenesis will be known to one of skill in the art. The ligated products or Kunkel products were transformed into electrocompetent E. coli cells of strain TG1 (obtained from Lucigen®). The E. coli cells were infected with M13K07 helper phage after recovery and grown overnight, after which library phage were precipitated with 5% PEG/NaCl, resuspended in 15% glycerol in PBS, and frozen until use. Typical library sizes ranged from about $10^9$ to about $10^{11}$ transformants. Fc-dimers were displayed on phage via pairing between pIII-fused Fc and soluble Fc not attached to pIII (the latter being generated due to the amber stop codon before pIII).

Generation of Yeast-Display Libraries

A DNA template coding for the wild-type human Fc sequence was synthesized and incorporated into a yeast display vector. For CH2 and CH3 libraries, the Fc polypeptides were displayed on the Aga2p cell wall protein. Both vectors contained prepro leader peptides with a Kex2 cleavage sequence, and a c-Myc epitope tag fused to the terminus of the Fc.

Yeast display libraries were assembled using methods similar to those described for the phage libraries, except that amplification of fragments was performed with primers containing homologous ends for the vector. Freshly prepared electrocompetent yeast (i.e., strain EBY100) were electroporated with linearized vector and assembled library inserts. Electroporation methods will be known to one of skill in the art. After recovery in selective SD-CAA media, the yeast were grown to confluence and split twice, then induced for protein expression by transferring to SG-CAA media. Typical library sizes ranged from about $10^7$ to about $10^9$ transformants. Fc-dimers were formed by pairing of adjacently displayed Fc monomers.

General Methods for Phage Selection

Phage methods were adapted from Phage Display: A Laboratory Manual (Barbas, 2001). Additional protocol details can be obtained from this reference.

Plate Sorting Methods

Human TfR target was coated on MaxiSorp® microtiter plates (typically 200 μL at 1-10 μg/mL in PBS) overnight at 4° C. All binding was done at room temperature unless otherwise specified. The phage libraries were added into each well and incubated overnight for binding. Microtiter wells were washed extensively with PBS containing 0.05% Tween® 20 (PBST) and bound phage were eluted by incubating the wells with acid (typically 50 mM HCl with 500 mM KCl, or 100 mM glycine, pH 2.7) for 30 minutes. Eluted phage were neutralized with 1 M Tris (pH 8) and amplified using TG1 cells and M13/K07 helper phage and grown overnight at 37° C. in 2YT media containing 50 μg/mL carbenacillin and 50 ug/mL Kanamycin. The titers of phage eluted from a target-containing well were compared to titers of phage recovered from a non-target-containing well to assess enrichment. Selection stringency was increased by subsequently decreasing the incubation time during binding and increasing washing time and number of washes.

Bead Sorting Methods

Human TfR target was biotinylated through free amines using NHS-PEG4-Biotin (obtained from Pierce™). For biotinylation reactions, a 3- to 5-fold molar excess of biotin reagent was used in PBS. Reactions were quenched with Tris followed by extensive dialysis in PBS. The biotinylated target was immobilized on streptavidin-coated magnetic beads, (i.e., M280-streptavidin beads obtained Thermo Fisher). The phage display libraries were incubated with the target-coated beads at room temperature for 1 hour. The unbound phage were then removed and beads were washed with PBST. The bound phage were eluted by incubating with 50 mM HCl containing 500 mM KCl (or 0.1 M glycine, pH 2.7) for 30 minutes, and then neutralized and propagated as described above for plate sorting.

After three to five rounds of panning, single clones were screened by either expressing Fc on phage or solubly in the E. coli periplasm. Such expression methods will be known to one of skill in the art. Individual phage supernatants or periplasmic extracts were exposed to blocked ELISA plates coated with target or a negative control and were subsequently detected using HRP-conjugated goat anti-Fc (obtained from Jackson Immunoresearch) for periplasmic extracts or anti-M13 (GE Healthcare) for phage, and then developed with TMB reagent (obtained from Thermo Fisher). Wells with $OD_{450}$ values greater than around 5-fold over background were considered positive clones and sequenced, after which some clones were expressed either as a soluble Fc fragment or fused to Fab fragments General Methods for Yeast Selection Bead Sorting (Magnetic-Assisted Cell Sorting (MACS)) Methods MACS and FACS selections were performed similarly to as described in Ackerman, et al. 2009 Biotechnol. Prog. 25(3), 774. Streptavidin magnetic beads (e.g., M-280 streptavidin beads from ThermoFisher) were labeled with biotinylated target and incubated with yeast (typically 5-10× library diversity). Unbound yeast were removed, the beads were washed, and bound yeast were grown in selective media and induced for subsequent rounds of selection.

Fluorescence-Activated Cell Sorting (FACS) Methods

Yeast were labeled with anti-c-Myc antibody to monitor expression and biotinylated target (concentration varied depending on the sorting round). In some experiments, the target was pre-mixed with streptavidin-Alexa Fluor® 647 in order to enhance the avidity of the interaction. In other experiments, the biotinylated target was detected after binding and washing with streptavidin-Alexa Fluor® 647. Singlet yeast with binding were sorted using a FACS Aria III cell sorter. The sorted yeast were grown in selective media then induced for subsequent selection rounds.

After an enriched yeast population was achieved, yeast were plated on SD-CAA agar plates and single colonies were grown and induced for expression, then labeled as described above to determine their propensity to bind to the target. Positive single clones were subsequently sequenced for binding target, after which some clones were expressed either as a soluble Fc fragment or as fused to Fab fragments.

General Methods for Screening

Screening by ELISA

Clones were selected from panning outputs and grown in individual wells of 96-well deep-well plates. The clones were either induced for periplasmic expression using auto-induction media (obtained from EMD Millipore) or infected with helper phage for phage-display of the individual Fc variants on phage. The cultures were grown overnight and spun to pellet E. coli. For phage ELISA, phage containing supernatant was used directly. For periplasmic expression, pellets were resuspended in 20% sucrose, followed by dilution at 4:1 with water, and shaken at 4° C. for 1 hour. Plates were spun to pellet the solids and supernatant was used in the ELISA.

ELISA plates were coated with target, typically at 0.5 mg/mL overnight, then blocked with 1% BSA before addition of phage or periplasmic extracts. After a 1-hour incubation and washing off unbound protein, HRP-conjugated secondary antibody was added (i.e., anti-Fc or anti-M13 for soluble Fc or phage-displayed Fc, respectively) and incubated for 30 minutes. The plates were washed again, and then developed with TMB reagent and quenched with 2N sulfuric acid. Absorbance at 450 nm was quantified using a plate reader (BioTek®) and binding curves were polotted using Prism software where applicable. Absorbance signal for tested clones was compared to negative control (phage or paraplasmic extract lacking Fc). In some assays, soluble holo-transferrin was added during the binding step, typically at significant molar excess (greater than 10-fold excess).

Screening By Flow Cytometry

Fc variant polypeptides (expressed either on phage, in periplasmic extracts, or solubly as fusions to Fab fragments) were added to cells in 96-well V-bottom plates (about 100,000 cells per well in PBS+1% BSA (PBSA)), and incubated at 4° C. for 1 hour. The plates were subsequently spun and the media was removed, and then the cells were washed once with PBSA. The cells were resuspended in PBSA containing secondary antibody (goat anti-human-IgG-Alexa Fluor® 647 (obtained from Thermo Fisher)). After 30 minutes, the plates were spun and the media was removed, the cells were washed 1-2 times with PBSA, and then the plates were read on a flow cytometer (i.e., a FACSCanto™ II flow cytometer). Median fluorescence values were calculated for each condition using FlowJo software and binding curves were plotted with Prism software.

CH2A2 Clone Generation and Characterization

Selections with CH2A2 Library Against Transferrin Receptor (TfR)

Phage and yeast libraries against CH2A2 were panned and sorted against TfR as described above. Clones binding human and/or cynomolgous (cyno) TfR were identified in ELISA assays, as described in the section titled "Screening by ELISA" above, after four rounds of phage panning. Sequences of representative clones fell into two groups: group 1 containing 15 unique sequences (i.e., SEQ ID NOS:47-61) and group 2 containing a single unique sequence (i.e., SEQ ID NO:62). Group 1 sequences had a conserved Glu-Trp motif at positions 60-61. No consensus appeared at any other positions, though position 58 favored Arg and position 59 favored Trp or Tyr.

Characterization of CH2A2 Clones

Individual CH2A2 variants were expressed on the surface of phage and assayed for binding to human TfR, cyno TfR, or an irrelevant control by ELISA. Expression of Fc was confirmed by ELSA against anti-Myc antibody 9E10, which bound to the C-terminal c-Myc epitope tag. The data for four representative clones, shown in FIGS. 1A-1D, demonstrated that all were well-expressed and bound to human TfR, while none bound to the irrelevant control. The three clones from group 1 also bound to cyno TfR, whereas the one clone from group 2 (i.e., clone 2A2.16) was specific for human TfR.

Figure 2A:
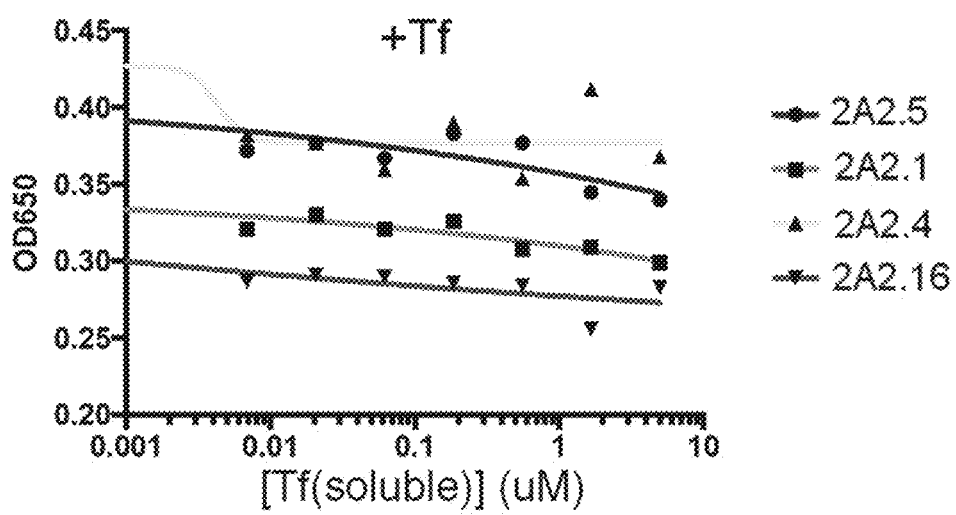
FIGS. 2A and 2B show phage ELISA results for CH2A2 clones binding to human TfR. Phage were added to TfR-coated ELISA plates at the approximate binding $EC_{50}$, and soluble holo-Tf or soluble TfR was added at varying concentrations. The data show that the CH2A2 clones competed with soluble TfR for binding to plate-coated TfR, but did not compete with holo-Tf.
Figure 2B:
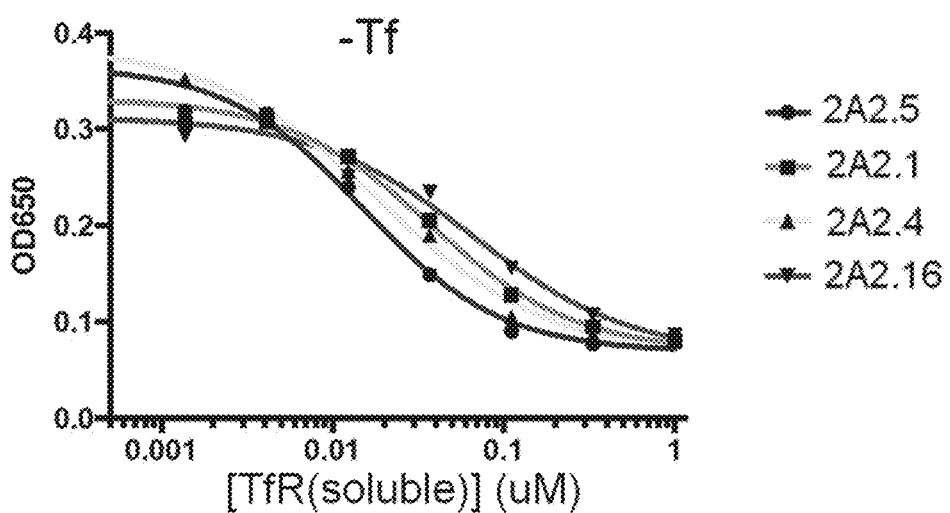

In a second assay, the concentration of phage was kept constant (i.e., at the approximate $EC_{50}$) and a varying concentration of a soluble competitor, either holo-transferrin or human TfR, was added. FIGS. 2A and 2B show that binding was not appreciably impacted by addition of holo-transferrin at concentrations up to 5 µM. Conversely, soluble human TfR could compete for binding to surface-adsorbed human TfR, indicating a specific interaction.

The CH2A2 variants are expressed as Fc fusions to anti-BACE1 Fab fragments by cloning into an expression vector containing an anti-BACE1 variable region sequence. After expression in 293 or CHO cells, the resulting CH2A2-Fab fusions were purified by Protein A and size-exclusion chromatography, and then assayed for binding using ELISAs, surface plasmon resonance (SPR; i.e., using a Biacore™ instrument), biolayer inferometry (i.e., using an Octet® RED system), cell binding (e.g., flow cytometry), and other methods described herein. Additionally, the resulting polypeptide-Fab fusions are characterized for stability by thermal melting, freeze-thaw, and heat-accelerated denaturation.

Additional Engineering of CH2A2 Clones

Two secondary libraries were constructed to enhance the binding affinity of the initial hits against human and cyno TfR. The first library was generated based on the group 1 clones. The conserved EW motif at positions 60 and 61 was held invariant, and the semi-conserved R at position 58 was mutated using soft randomization. The other library positions (i.e., positions 47, 49, 56, 59, 62, and 63) were mutated by saturation mutagenesis. The second library was constructed based on the group 2 clone. This library was generated by soft randomization of the original CH2A2 library positions, but used clone 2A2.16 (SEQ ID NO:62) as the template (rather than wild-type Fc (SEQ ID NO:1)). Both libraries were constructed for phage and yeast display using methods described above.

The libraries were screened using methods described above and several clones that bound human TfR by ELISA were identified (Table 1).

CH2C Clone Generation and Characterization

Selections with CH2C Library Against Transferrin Receptor (TfR)

Phage and yeast libraries against CH2C were panned and sorted against TfR as described above. Clones binding human and/or cynomolgous (cyno) TfR were identified in ELISA assays, as described in the section titled "Screening by ELISA" above, after four rounds of phage panning (i.e., group 1 and 4 clones), and additional clones were identified after four or five yeast sort rounds (i.e., group 2 and 3 clones), by yeast binding assays as described in the section titled "General Methods for Yeast Selection" above. Sequences of representative clones fell into four groups: group 1 containing 16 unique sequences (i.e, SEQ ID NOS:63-78), group 2 containing 4 unique sequences (i.e., SEQ ID NOS:79-82), group 3 containing 2 unique sequences (i.e., SEQ ID NOS:83-84), and group 4 containing a single sequence (i.e., SEQ ID NO:85). The group 1 sequences had a semi-conserved Pro at position 39, a semi-conserved Pro at position 42, a conserved Pro at position 43, a semi-conserved Trp at position 44, a semi-conserved Glu at position 68, a conserved Tyr at position 70, and little specific preference at other library positions. The group 2 sequences had a conserved Met at position 39, a semi-conserved L at position 40, a conserved Pro at position 42, a conserved Val at position 43, a semi-conserved Pro at position 44, a semi-conserved Thr at position 68, a conserved His at position 70, and a conserved Pro at position 72. The two group 3 sequences only differed at position 68, where either a Val or Leu was present. Group 4 consisted of a single clone (i.e., CH2C.23) with a sequence as indicated in SEQ ID NO:85.

Characterization of CH2C Clones

Figure 3A:
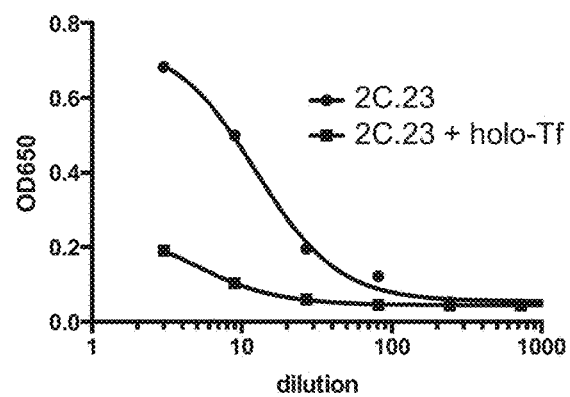
FIGS. 3A-3D show binding of CH2C clones to TfR in the presence or absence of holo-Tf.
Figure 3B:
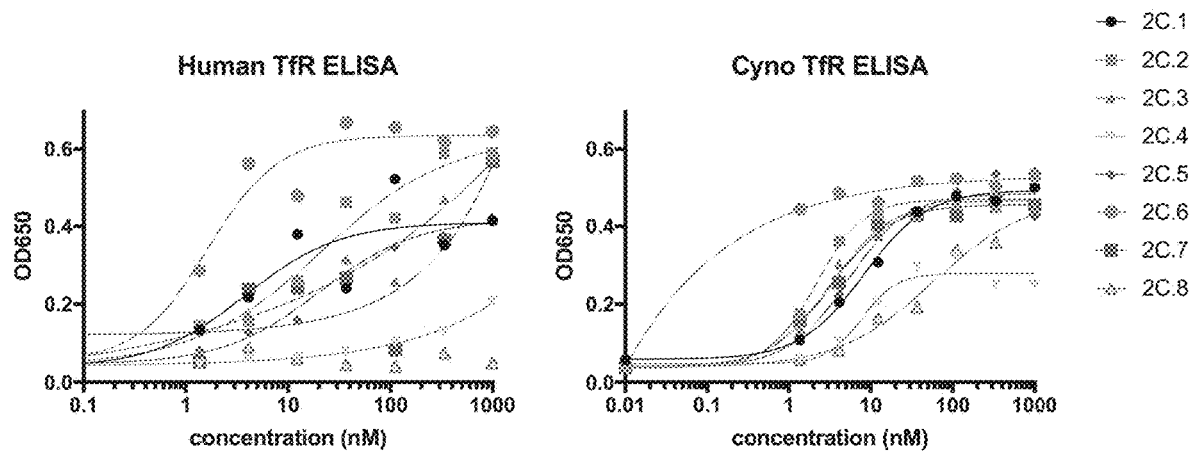
Figure 3C:
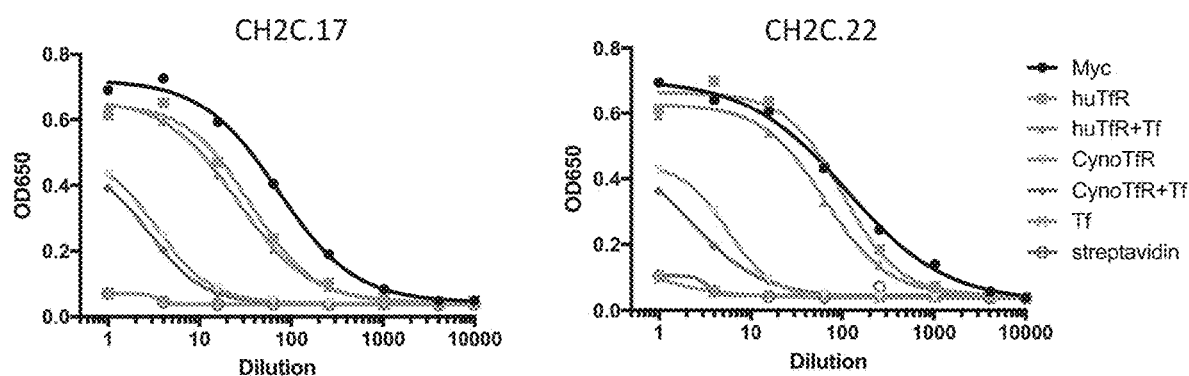
Figure 3D:
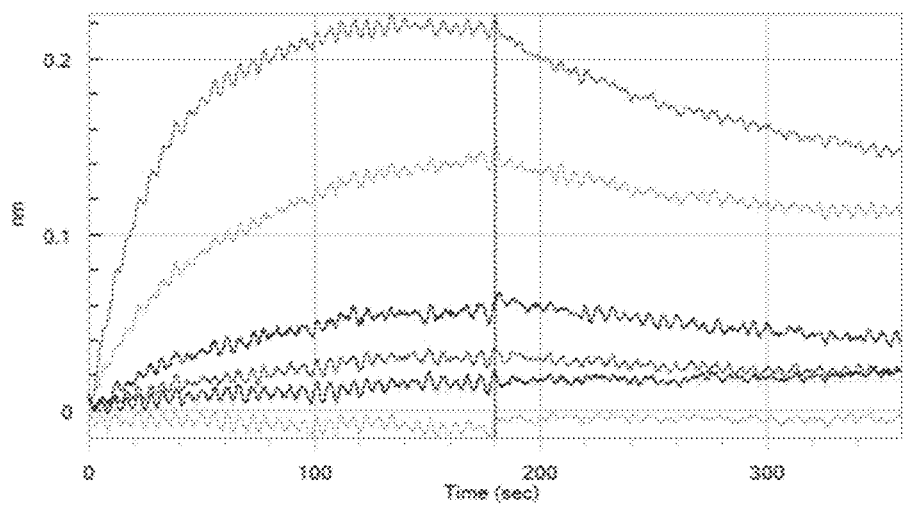

The CH2C variants were expressed as Fc fusions to Fab fragments by cloning into an expression vector containing an anti-BACE1 benchmark variable region sequence. After expression in 293 or CHO cells, the resulting polypeptide-Fab fusions were purified by Protein A and size-exclusion chromatography, then assayed for binding to human or cyno TfR. As shown in FIG. 3A, the group 4 clone CH2C.23 competed with holo-transferrin. Clones belonging to sequence group 1 are shown in binding titrations against human and cyno TfR in FIG. 3B. Representative clones from other sequence groups were tested on phage for binding in the presence or absence of holo-Tf (see, FIG. 3C), and clone CH2C.7 was tested for binding to human TfR in the presence of holo-transferrin by biolayer interferometry (i.e., using an Octet® RED system; see, FIG. 3D). Most clones showed some cross-reactivity to cyno TfR, and except for clone CH2C.23, the clones that were tested did not compete with holo-Tf.

CH3B Clone Generation and Characterization

Selections with CH3B Library Against Transferrin Receptor (TfR)

Phage and yeast libraries against CH3B were panned and sorted against TfR as described above. Clones binding human and/or cyno TfR were identified in ELISA assays, as described in the section titled "Screening by ELISA" above, after four rounds of phage panning, and additional clones were identified after four or five yeast sort rounds, by yeast binding assays as described in the section titled "General Methods for Yeast Selection" above. All 17 clones (i.e., SEQ ID NOS:30-46) identified from both phage and yeast had related sequences; the sequences had a semi-conserved Phe at position 118, a semi-conserved negatively charged Asp or Glu at position 119, a semi-conserved Thr at position 122, a conserved G at position 210, a conserved Phe at position 211, a semi-conserved His at position 212, and a conserved Asp at position 213. Several clones had a T123I mutation, which was not a position intentionally mutated in the library design, but presumably was introduced by recombination or PCR error.

Characterization of CH3B Clones

Figure 4A:
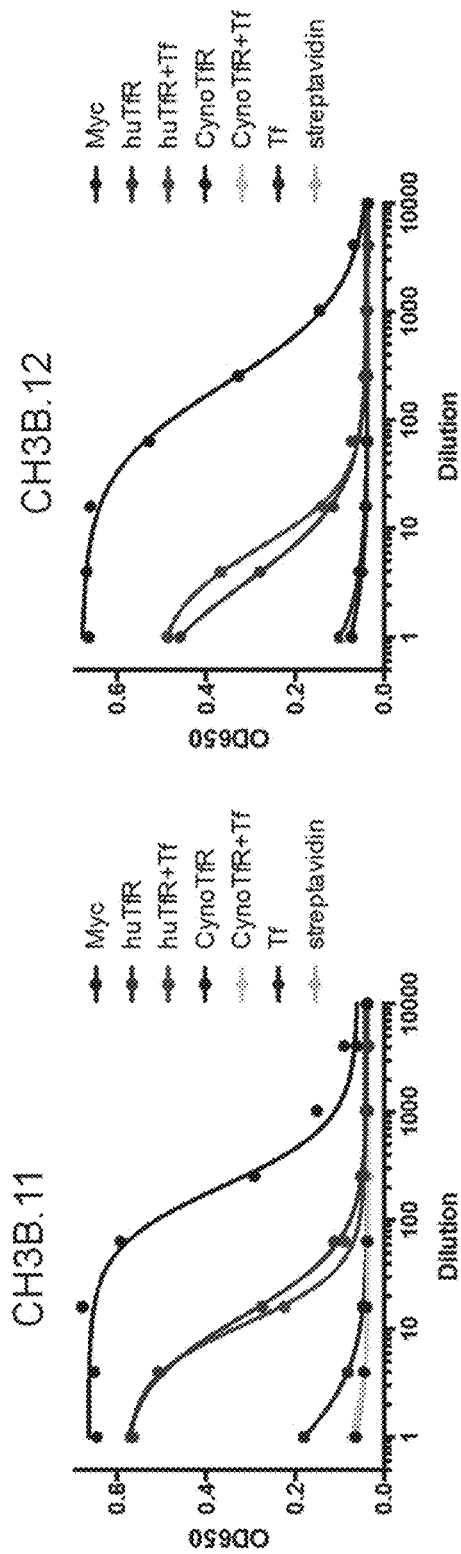
FIGS. 4A and 4B show binding of CH3B clones to TfR in the presence or absence of holo-Tf.
Figure 4B:
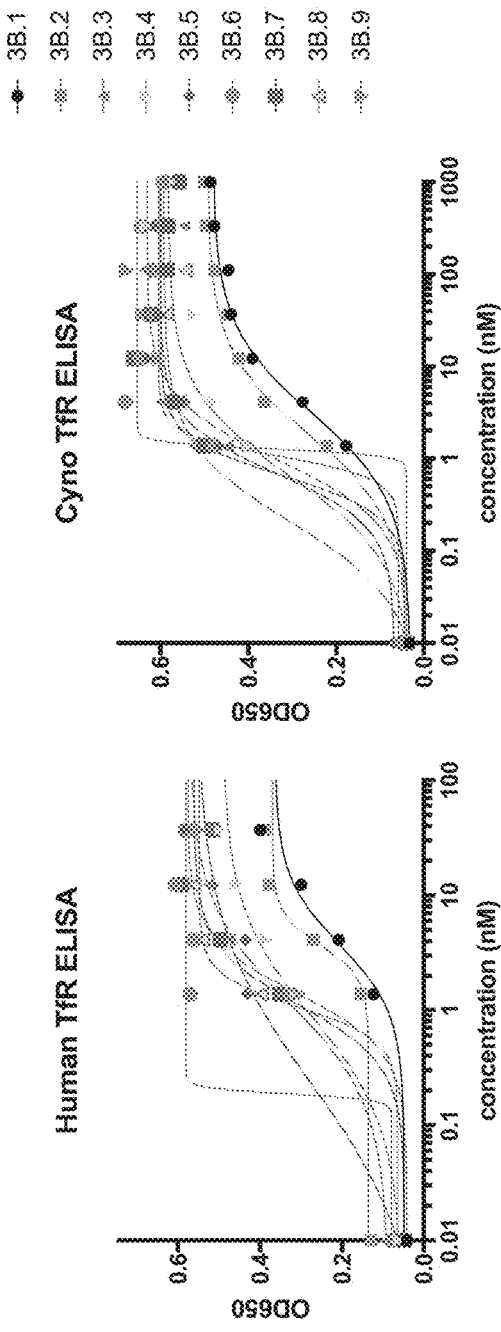

Two representative clones, CH3B.11 (SEQ ID NO:40) and CH3B.12 (SEQ ID NO:41), were expressed on the surface of phage and tested for binding to human and cyno TfR in the presence or absence of holo-Tf. Neither clone was affected by the addition of holo-Tf (FIG. 4A). Additionally, the CH3B variants were expressed as fusions to Fab fragments by cloning into an expression vector containing an anti-BACE1 variable region sequence. After expression in 293 or CHO cells, the resulting polypeptide-Fab fusions were purified by Protein A and size-exclusion chromatography, then assayed for binding to human or cyno TfR (FIG. 4B). All showed specific binding to both orthologs.

Additional Engineering of CH3B Clones

Figure 5:
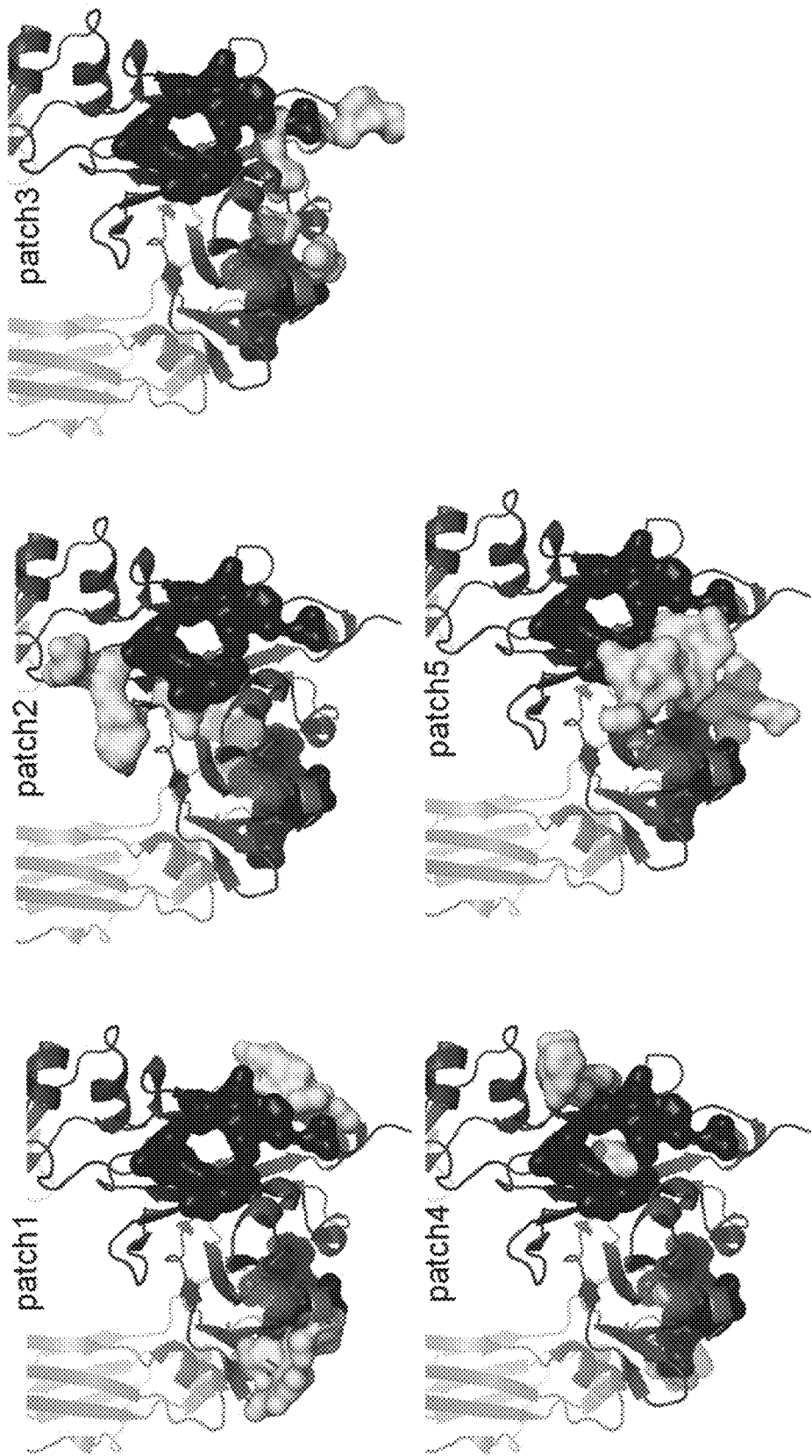
FIG. 5 shows NNK patch libraries for maturation of CH3B clones. Ribbons show the backbone of the CH3 domain, where the dark surfaces represent the original CH3B registers and the light surface patches represent the expanded repertoires.

Additional engineering methods, similar to those described above for CH2A2 for the design and screening of additional libraries, were used to improve the affinity of CH3B clones. In particular, several series of four to seven residue patches near the paratope were selected for additional diversification, as shown in FIG. 5 (the dark surface represents the original library register; the light patch represents the newly mutagenized positions). Clone CH3B.12 (SEQ ID NO:41) was used as a starting point; the residues selected for saturation (i.e., NNK) mutagenesis were as follows:

CH3B-patch1 (SEQ ID NO:101): amino acid positions 127, 128, 129, 131, 132, 133, and 134;

CH3B-patch2 (SEQ ID NO:102): amino acid positions 121, 206, 207, and 209;

CH3B-patch3 (SEQ ID NO:103): amino acid positions 125, 214, 217, 218, 219, and 220;

CH3B-patch4 (SEQ ID NO:104): amino acid positions 115, 117, 143, 174, and 176; and CH3B-patch5 (SEQ ID NO:105): amino acid positions 155, 157, 158, 193, 194, and 195.

The libraries were generated using PCR mutagenesis and put into yeast and phage as described in the sections titled "Generation of Phage-Display Libraries" and "Generation of Yeast-Display Libraries" above. The libraries were screened using methods described above and several clones that bound human TfR by ELISA were identified (Table 5).

CH2D Clone Generation and Characterization

Selections with CH2D Library Against Transferrin Receptor (TfR)

Phage libraries against CH2D were panned against TfR as described above. Clones binding human and/or cyno TfR were identified in ELISA assays, as described in the section titled "Screening by ELISA" above. Five unique clones were identified which were grouped into two sequence families of 2 and 3 sequences, respectively (Table 3). Sequence group 1 (i.e., clones CH2D.1 (SEQ ID NO:86) and CH2D.2 (SEQ ID NO:87)) had a conserved VPPXM (SEQ ID NO:111) motif at positions 40-45, an SLTS (SEQ ID NO:112) motif at positions 64-67, and V at position 73. Mutations at position 40 were not included in the design and were likely due to PCR error or recombination. Sequence group 2 (i.e., clones CH2D.3 (SEQ ID NO:88), CH2D.4 (SEQ ID NO:89), and CH2D.5 (SEQ ID NO:90)) had a conserved D at position 41, a semi-conserved D at position 42, a conserved W at position 43, a semi-conserved E at position 44, a conserved aromatic (W or Y) at position 45, a conserved PW motif at positions 64-65, and a conserved W at position 73.

Characterization and Additional Engineering of CH2D Clones

CH2D variants were expressed as fusions to Fab fragments by cloning into an expression vector containing an anti-BACE1 variable region sequence. After expression in 293 or CHO cells, the resulting polypeptide-Fab fusions were purified by Protein A and size-exclusion chromatography, then assayed for binding to cyno and human TfR in the presence or absence of holo-Tf using methods previously described herein.

CH2E3 Clone Generation And Characterization

Selections with CH2E3 Library Against Transferrin Receptor (TfR)

Phage libraries against CH2E3 were panned against TfR as described above. Clones binding human and/or cyno TfR were identified in ELISA assays, as described in the section titled "Screening by ELISA" above. Three sequence groups were identified from 5 sequences, though two of the groups only consisted of one unique sequence each (Table 4). Sequence group 2, which had 3 unique sequences (i.e., clones CH2E3.2 (SEQ ID NO:92), CH2E3.3 (SEQ ID NO:93), and CH2E3.4 (SEQ ID NO:94)), had a semi-conserved Val at position 45, a conserved Gly at position 47, a conserved Arg at position 49, a conserved Arg at position 95, a conserved Ser at positions 97 and 99, a conserved Trp at position 103, and an Arg or Lys at position 104.

Characterization and Additional Engineering of CH2E3 Clones

CH2E3 variants were expressed as fusions to Fab fragments by cloning into an expression vector containing an anti-BACE1 benchmark variable region sequence. After expression in 293 or CHO cells, the resulting polypeptide-Fab fusions were purified by Protein A and size-exclusion chromatography, then assayed for binding to cyno and human TfR in the presence or absence of holo-Tf using methods for binding previously described herein.

CH3C Clone Generation And Characterization

Selections with CH3C library against transferrin receptor (TfR)

Figure 6:
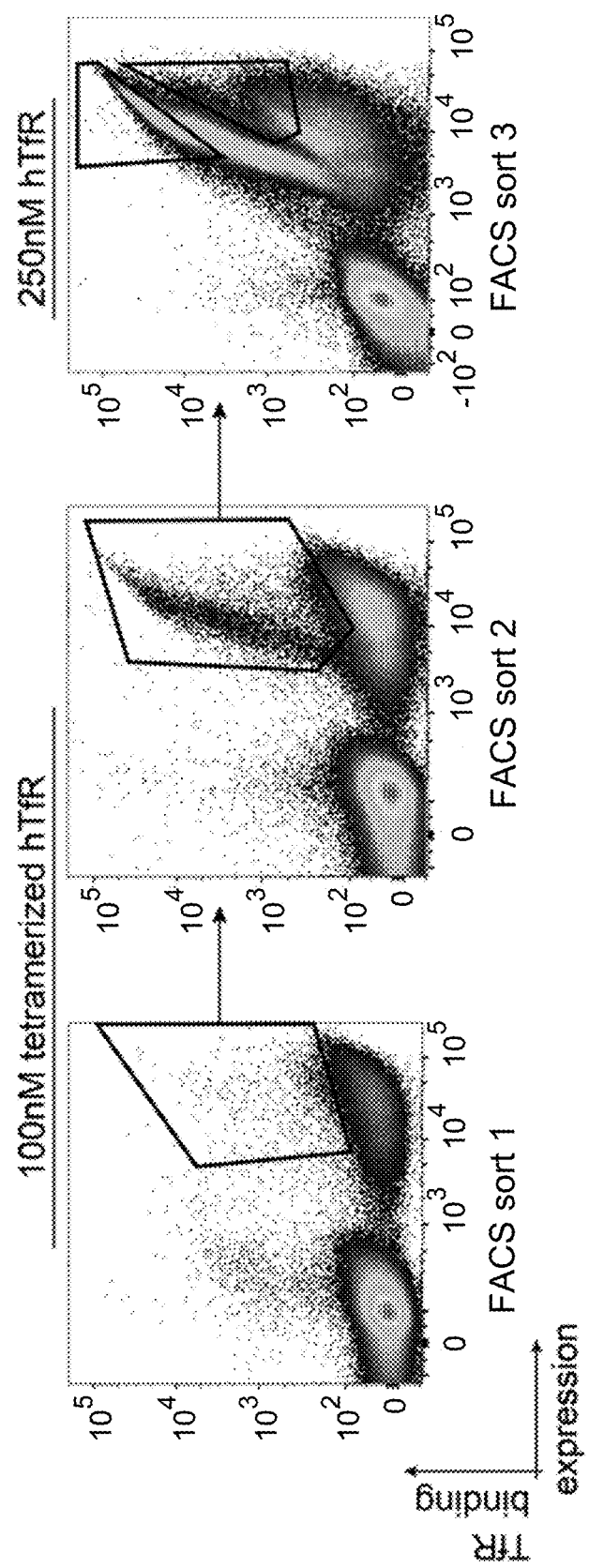
FIG. 6 shows FACS plots for CH3C clone selections on yeast, showing enrichment of binding population after 3 sort rounds. In sort rounds 1 and 2, biotinylated TfR was pre-loaded on streptavidin-Alexa Fluor® 647 prior to incubating with the yeast. In sort round 3, biotinylated TfR was incubated with the yeast first, and streptavidin-Alexa Fluor® 647 was added for secondary detection. In all sort rounds, expression was monitored using a chicken anti-c-Myc antibody (obtained from Thermo Fisher) against the C-terminal Myc tag on the yeast display construct.

Yeast libraries against CH3C were panned and sorted against TfR as described above. Population enrichment FACS plots for the first three sort rounds are shown in FIG. 6. After an additional two rounds of sorting, single clones were sequenced and four unique sequences (i.e., clones CH3C.1 (SEQ ID NO:4), CH3C.2 (SEQ ID NO:5), CH3C.3 (SEQ ID NO:6), and CH3C.4 (SEQ ID NO:7)) were identified. These sequences had a conserved Trp at position 161, and all had an aromatic residue (i.e., Trp, Tyr, or His) at position 194. There was a great deal of diversity at other positions.

Characterization of First Generation CH3C Clones

Figure 7A:
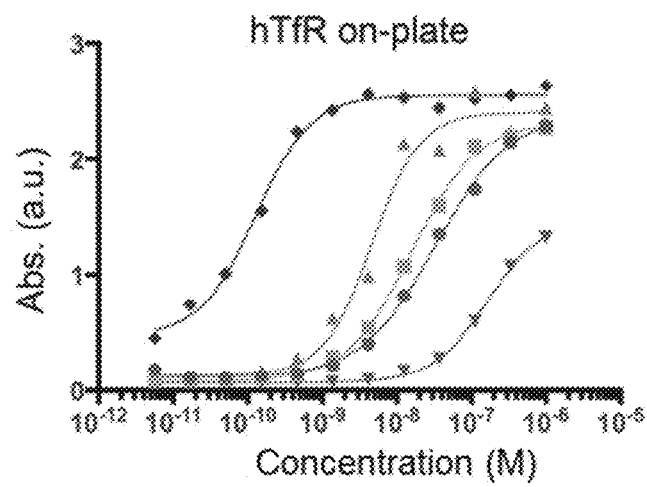
FIGS. 7A-7C show binding of CH3C clones to TfR in the presence or absence of holo-Tf. Clones were assayed in a Fc-Fab fusion format. Ab204, a standard antibody with variable regions that bind to TfR, was used as a positive control in this assay.
Figure 7B:
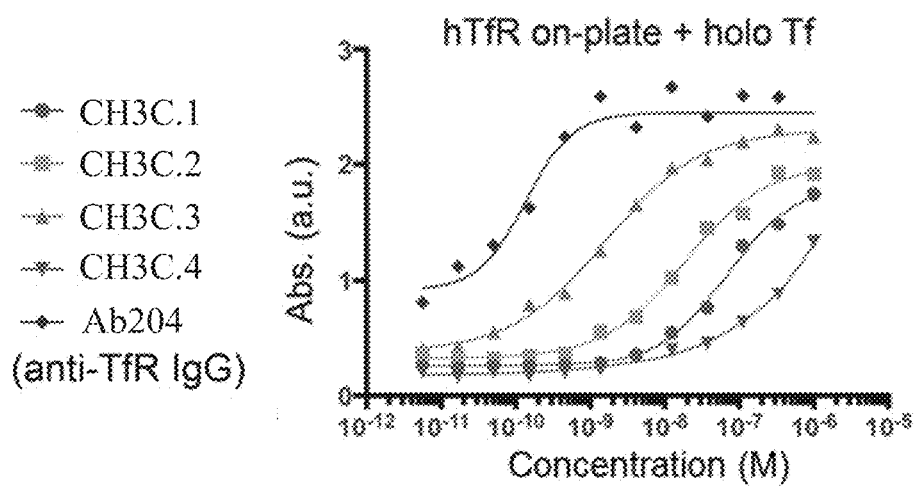
Figure 7C:
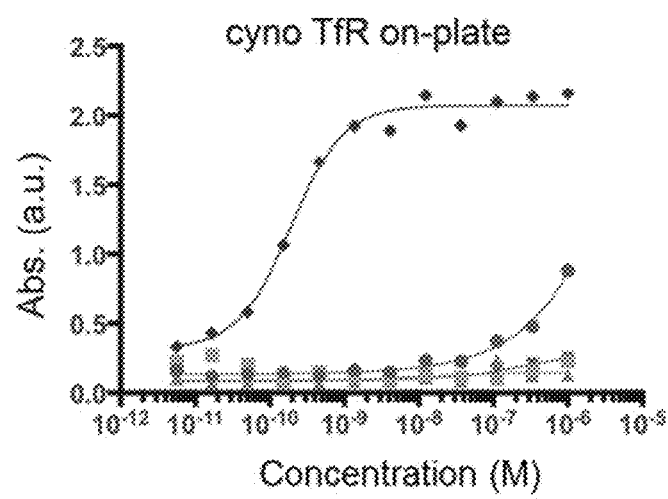
Figure 8:
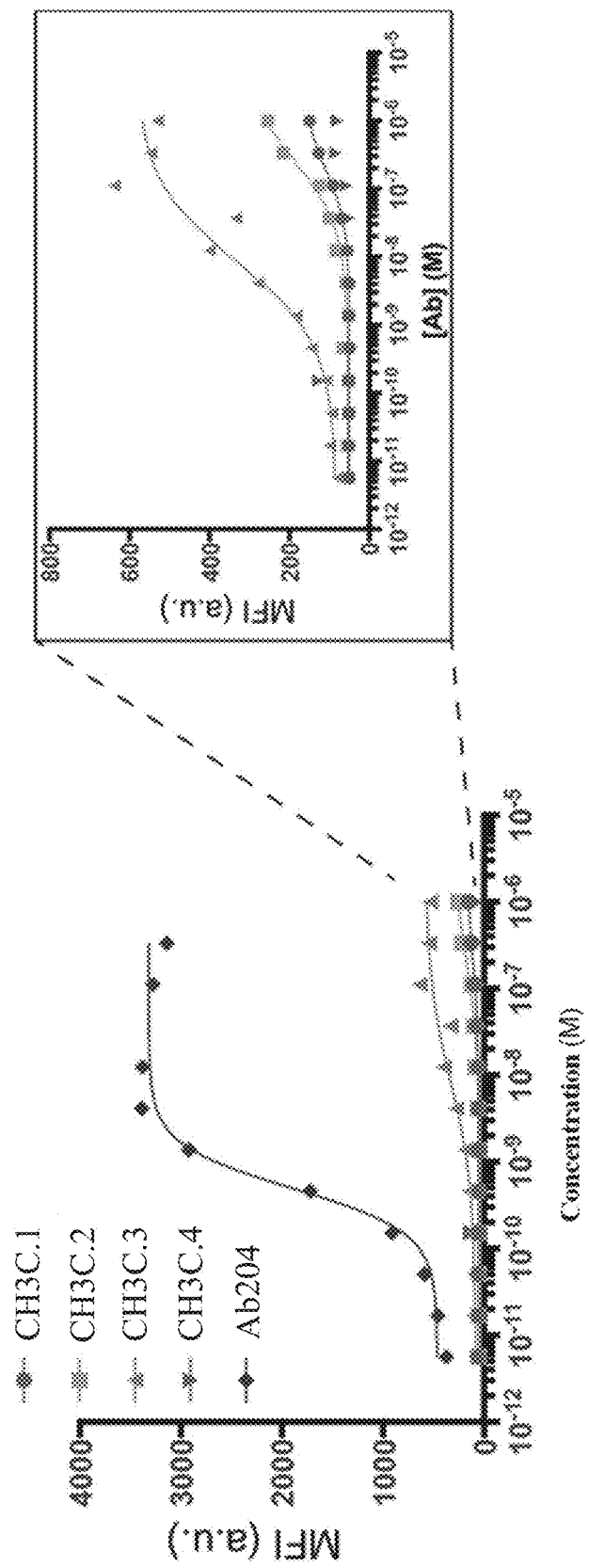
FIG. 8 shows binding of CH3C clones to 293F cells, which endogenously express human TfR. Cells were distributed in 96-well V bottom plates, and varying concentrations of the CH3C clones, formatted as Fc-Fab fusion binding proteins, were added. After 1 hour incubation at 4° C., the plates were spun and washed, and then incubated with goat-anti-human-IgG-Alexa Fluor® 647 secondary antibody at 4° C. for 30 minutes. After additional washing of the cells, the plates were read on a FACSCanto™ II flow cytometer, and median fluorescence values in the APC (647 nm) channel were determined using FlowJo® software.

The four clones selected from the CH3C library were expressed as Fc fusions to Fab fragments in CHO or 293 cells, and purified by Protein A and size-exclusion chromatography, and then screened for binding to cyno and human TfR in the presence or absence of holo-Tf by ELISA. As shown in FIG. 7, the clones all bound to human TfR and the binding was not affected by the addition of excess (5 µM) holo-Tf. However, the clones did not bind appreciably to cyno TfR. Clones were also tested for binding to 293F cells, which endogenously express human TfR. FIG. 8 shows that while the clones bound to 293F cells, the overall binding was substantially weaker than the high-affinity positive control.

Figure 9A:
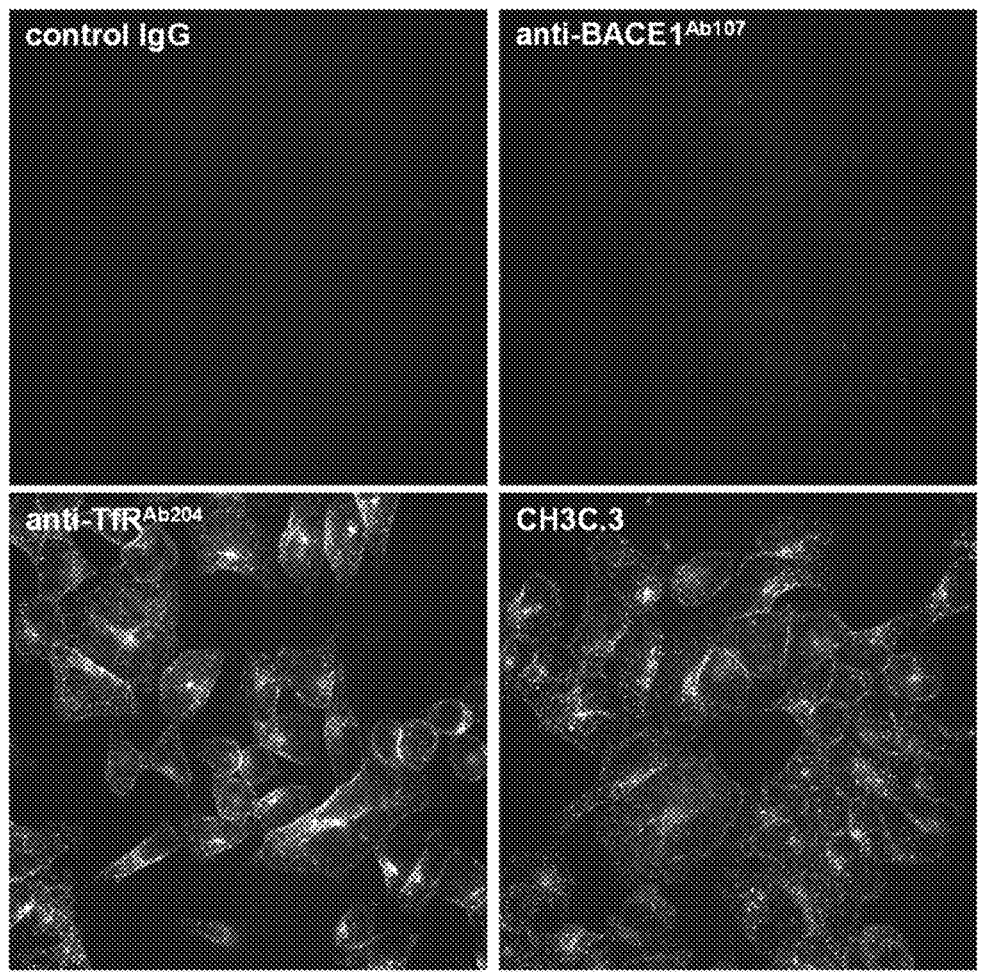
FIGS. 9A and 9B show internalization of CH3C.3 in HEK293 cells, which endogenously express human TfR. CH3C.3 or controls were added at 1 µM concentration at 37° C. and 8% $CO_2$ concentration for 30 minutes, then the cells were washed, permeabilized, and stained with anti-human-IgG-Alexa Fluor® 488 secondary antibody. After additional washing, the cells were imaged by fluorescence microscopy and the number of puncta was quantified.
Figure 9B:
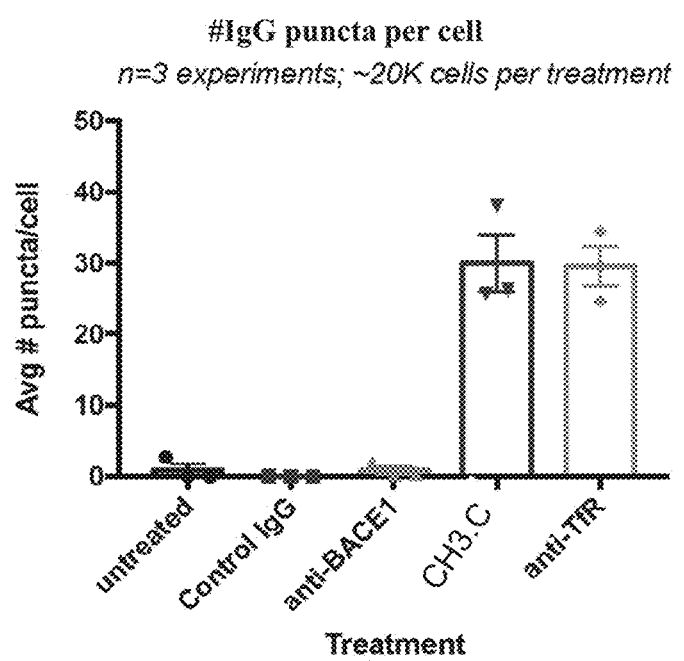

Next it was tested whether clone CH3C.3 could internalize in TfR-expressing cells. Adherent HEK293 cells were grown in 96-well plates to about 80% confluence, media was removed, and samples were added at 1 µM concentrations: CH3C.3 anti-TfR benchmark positive control antibody (Ab204), anti-BACE1 benchmark negative control antibody (Ab107), and human IgG isotype control (obtained from Jackson Immunoresearch). The cells were incubated at 37° C. and 8% $CO_2$ concentration for 30 minutes, then washed, permeabilized with 0.1% Triton™ X-100, and stained with anti-human-IgG-Alexa Fluor® 488 secondary antibody. After additional washing, the cells were imaged under a high content fluorescence microscope (i.e., an Opera Phenix™ system), and the number of puncta per cell was quantified, as shown in FIG. 9. At 1 µM, clone CH3C.3 showed a similar propensity for internalization to the positive anti-TfR control, while the negative controls showed no internalization.

Secondary Engineering of CH3C Clones

Additional libraries were generated to improve the affinity of the initial CH3C hits against human TfR, and to attempt to introduce binding to cyno TfR. A soft randomization approach was used, wherein DNA oligos were generated to introduce soft mutagenesis based on each of the original four hits. The first portion of the register (WESXGXXXXXYK; SEQ ID NO:113) and the second portion of the register (TVXKSXWQQGXV; SEQ ID NO:114) were built via separate fragments, so the soft randomized registers were shuffled during PCR amplification (e.g., the first portion of the register from clone CH3C.1 was mixed with the second portion of the register from clones CH3C.1, CH3C.2, CH3C.3, and CH3C.4, and so forth). The fragments were all mixed and then introduced into yeast for surface expression and selection.

Figure 10:
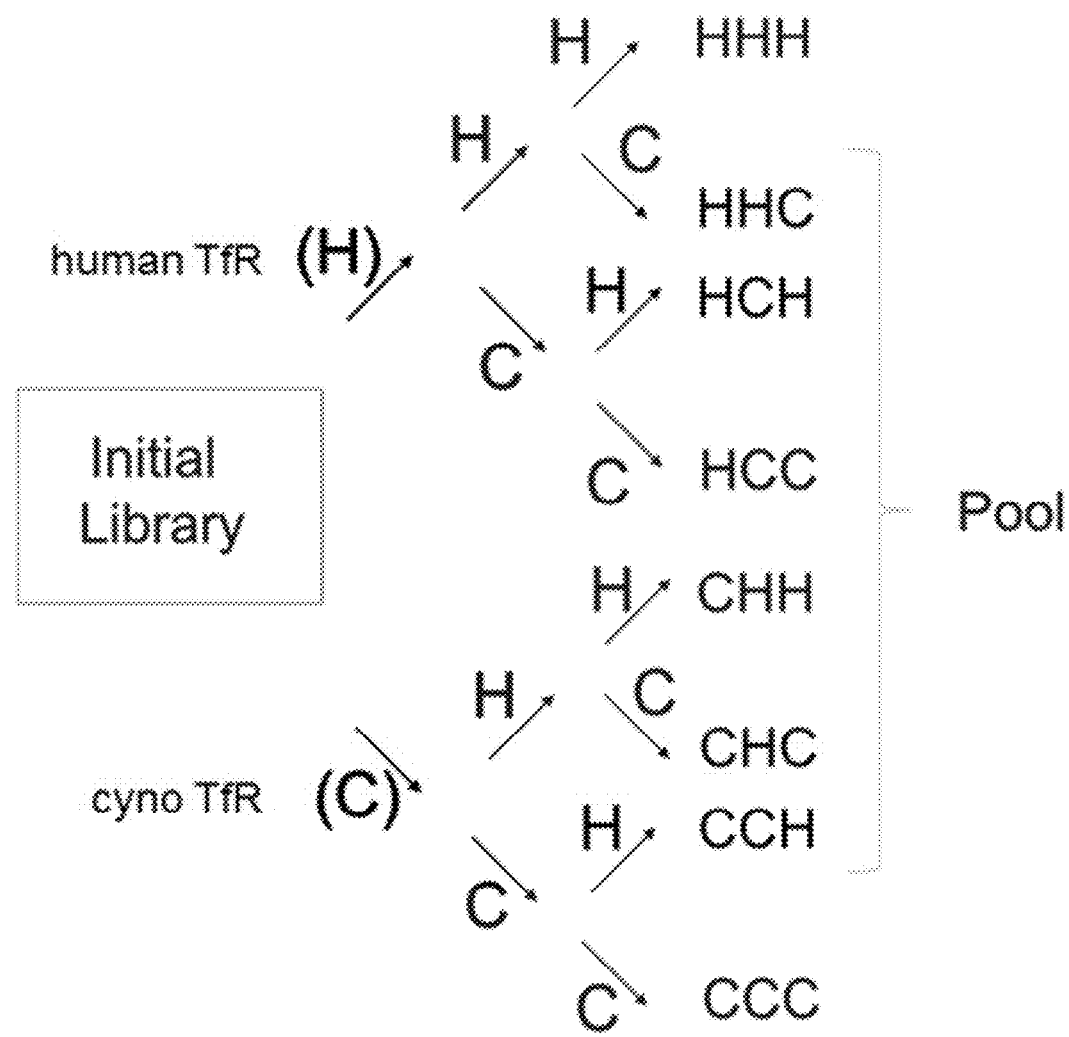
FIG. 10 shows the selection scheme for the CH3C soft library. The initial library was sorted by MACS against either human (H) or cyno (C) TfR. The resulting yeast pools were then split and each sorted against human or cyno TfR as in the first FACS sort round. The resulting pools were split again for another FACS sort round. Finally, the HHH and CCC pools were kept separate and the other pools which had seen both species of target were finally pooled.
Figure 11A:
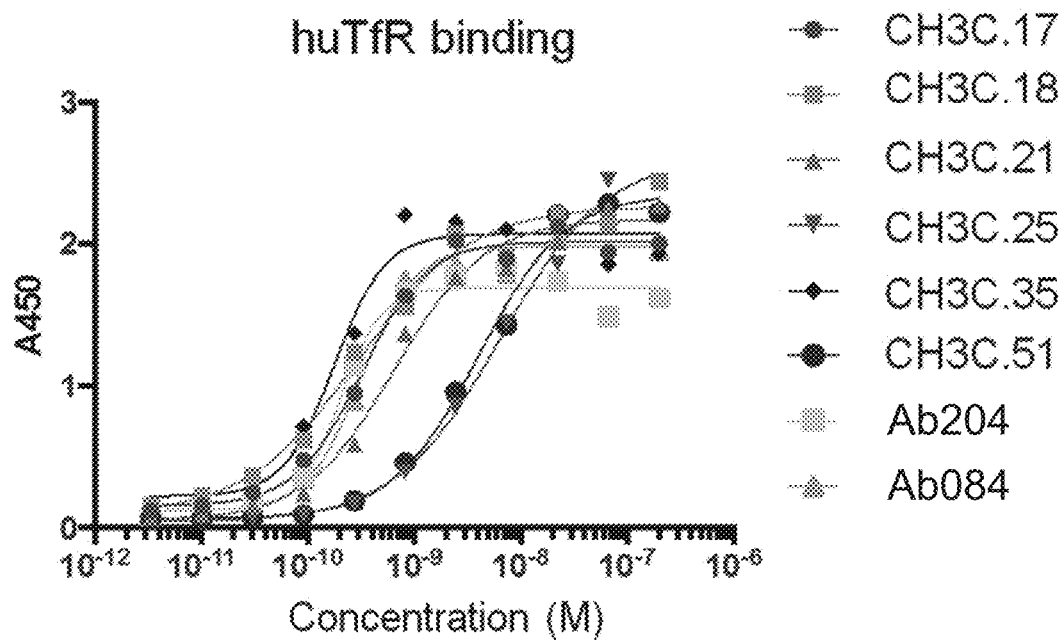
FIGS. 11A and 11B show binding of CH3C clones identified from the first soft randomization library to human and cyno TfR. Positive controls were Ab204, a high affinity anti-TfR antibody, and Ab084, a low-affinity anti-TfR antibody.
Figure 11B:
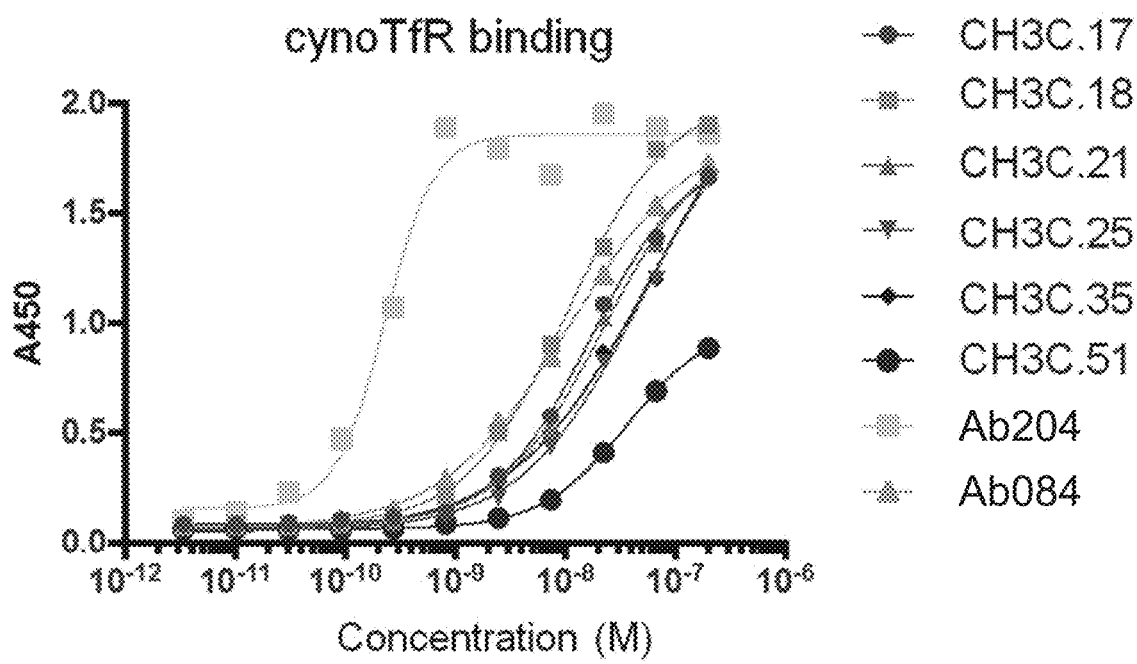

The selection scheme is shown in FIG. 10. After one round of MACS and three rounds of FACS, individual clones were sequenced (clones CH3C.17 (SEQ ID NO:8), CH3C.18 (SEQ ID NO:9), CH3C.21 (SEQ ID NO:10), CH3C.25 (SEQ ID NO:11), CH3C.34 (SEQ ID NO:12), CH3C.35 (SEQ ID NO:13), CH3C.44 (SEQ ID NO:14), and CH3C.51 (SEQ ID NO:15)). The selected clones fell into two general sequence groups. Group 1 clones (i.e., clones CH3C.18, CH3C.21, CH3C.25, and CH3C.34) had a semi-conserved Leu at position 157, a Leu or His at position 159, a conserved and a semi-conserved Val at positions 160 and 162, respectively, and a semi-conserved P-T-W motif at positions 186, 189, and 194, respectively. Group 2 clones had a conserved Tyr at position 157, the motif TXWSX (SEQ ID NO:602) at positions 159-163, and the conserved motif S/T-E-F at positions 186, 189, and 194, respectively. Clones CH3C.18 and CH3.35 were used in additional studies as representative members of each sequence group. It was noted that clone CH3C.51 had the first portion of its register from group 1 and the second portion of its register from group 2.

Binding Characterization of CH3C Clones from the Soft Mutagenesis Library

Figure 12B:
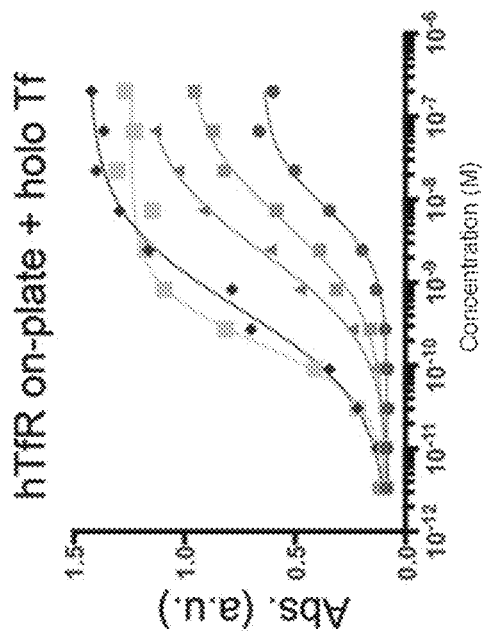
FIGS. 12A and 12B show binding of CH3C clones identified from the first soft randomization library to human TfR in the presence or absence of holo-Tf. Clones were in Fc-Fab fusion format. Ab204, a high affinity anti-TfR antibody, was used as a positive control in this assay.
Figure 12A:
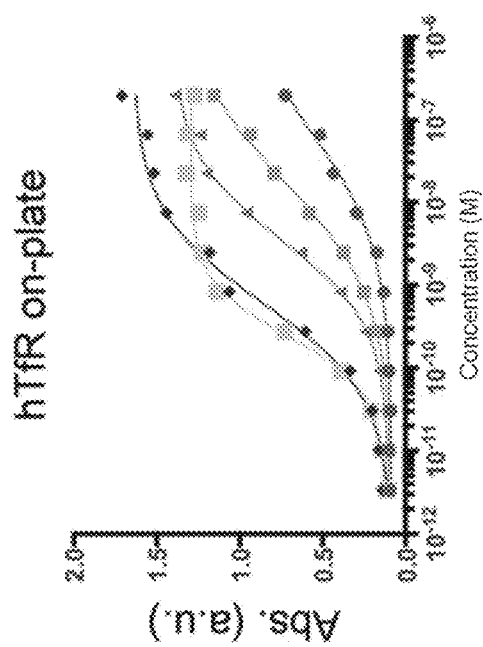

Clones from the soft mutagenesis library were reformatted as Fc-Fab fusion polypeptides and expressed and purified as described above. As shown in FIG. 12, these variants had improved ELISA binding to human TfR as compared to the top clone from the initial library selections (CH3C.3), and also did not compete with holo-Tf. The $EC_{50}$ values, as shown below in Table 7, were not appreciably affected beyond the margin of error of the experiment by the presence or absence of holo-Tf.

TABLE 7

$EC_{50}$ values (nM) for ELISA binding of CH3C variants to TfR in the presence or absence of holo-Tf

| Clone | −Tf | +Tf |
|---|---|---|
| CH3C.3 | 8.1 | 6.3 |
| CH3C.17 | 5.3 | 17 |
| CH3C.18 | 6.9 | 3.5 |
| CE3C.25 | 51 | 48 |
| CH3C.35 | 0.49 | 0.61 |
| CH3C.51 | 160 | 36 |
| Ab204 | 1.6 | 0.24 |

Figure 14A:
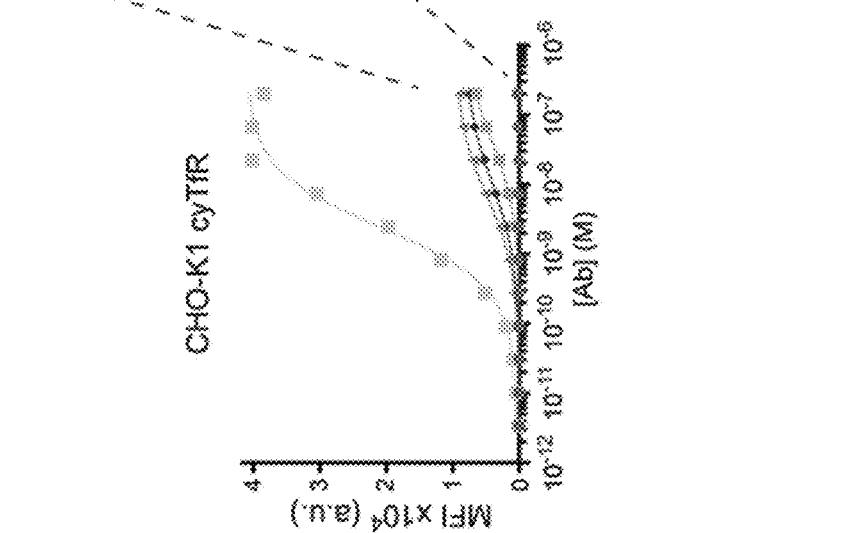
FIGS. 14A-14C show binding of CH3C clones identified from the first soft randomization library to CHO-K1 cells. Cells were distributed in 96-well V bottom plates, and varying concentrations of the CH3C clones, formatted as Fc-Fab fusions, were added. After 1 hour incubation at 4° C., the plates were spun and washed, and then incubated with goat-anti-human-IgG-Alexa Fluor® 647 secondary antibody at 4° C. for 30 minutes. After additional washing of the cells, the plates were read on a FACSCanto™ II flow cytometer, and median fluorescence values in the APC (647 nm) channel were determined using FlowJo® software.
Figure 14B:
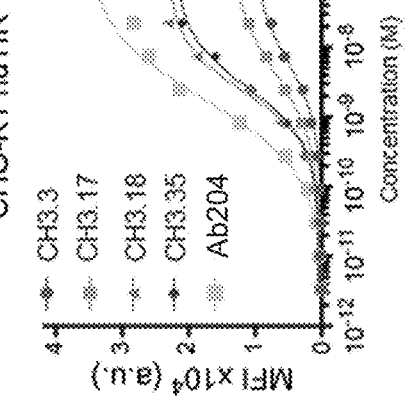
Figure 14C:
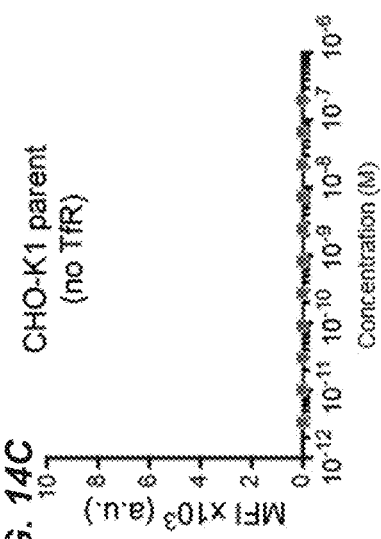
Figure 15A:
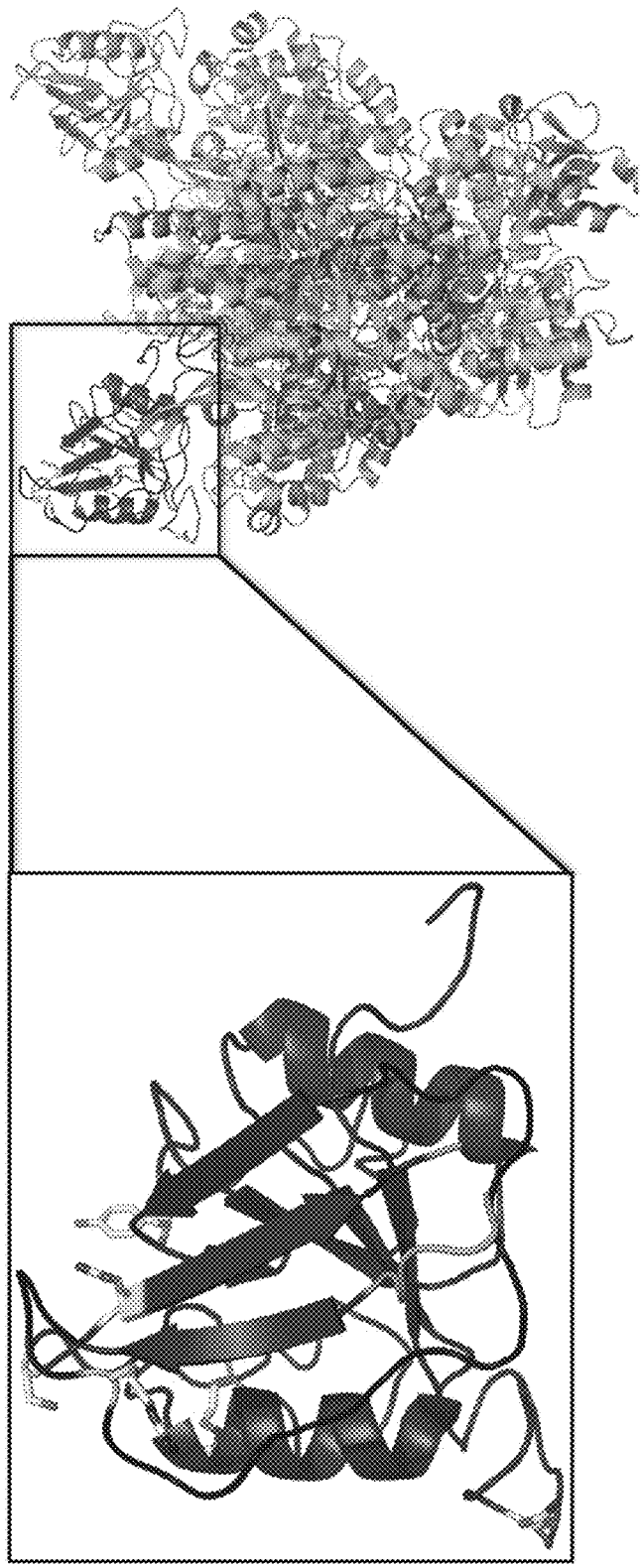
FIGS. 15A and 15B show the TfR apical domain.
Figure 15B:
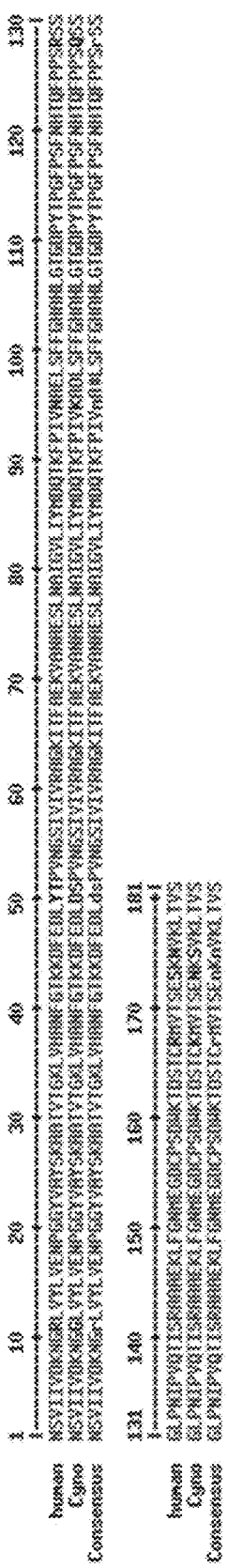
Figure 17A:
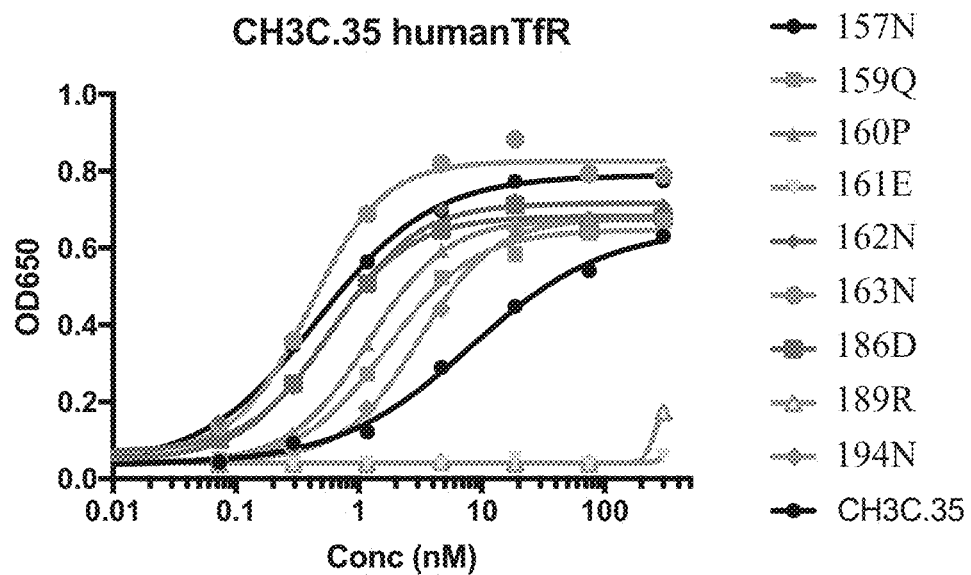
FIGS. 17A-17D show paratope mapping of CH3C variants by reverting mutated positions to wild-type residues.
Figure 17B:
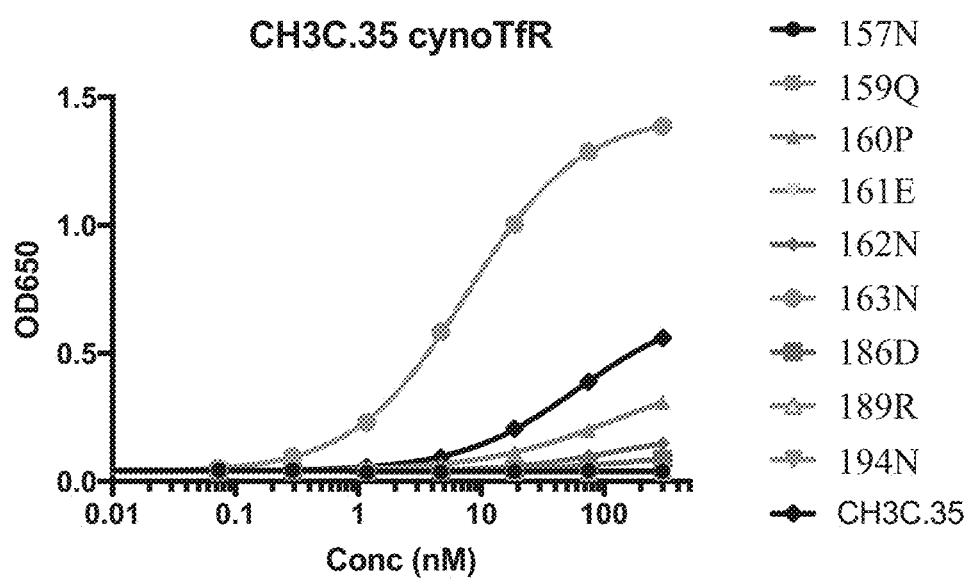
Figure 17C:
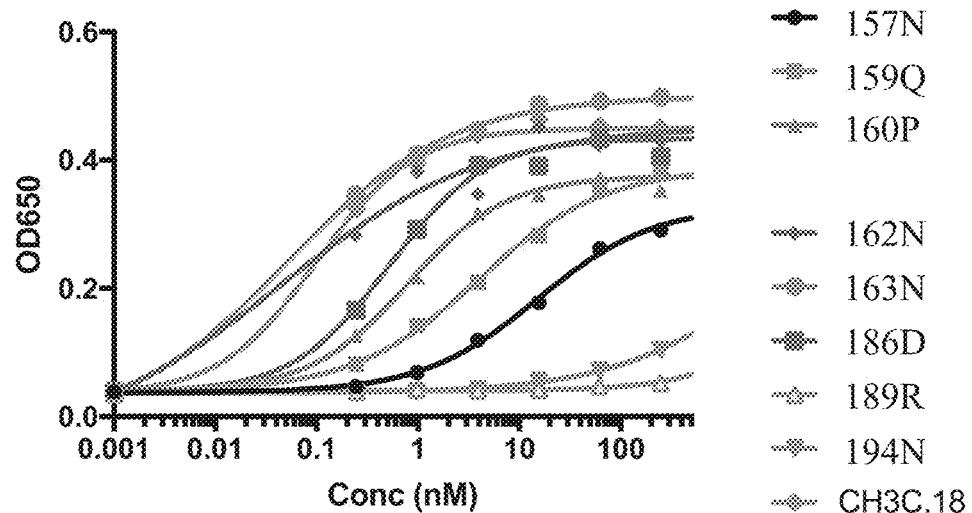
Figure 17D:
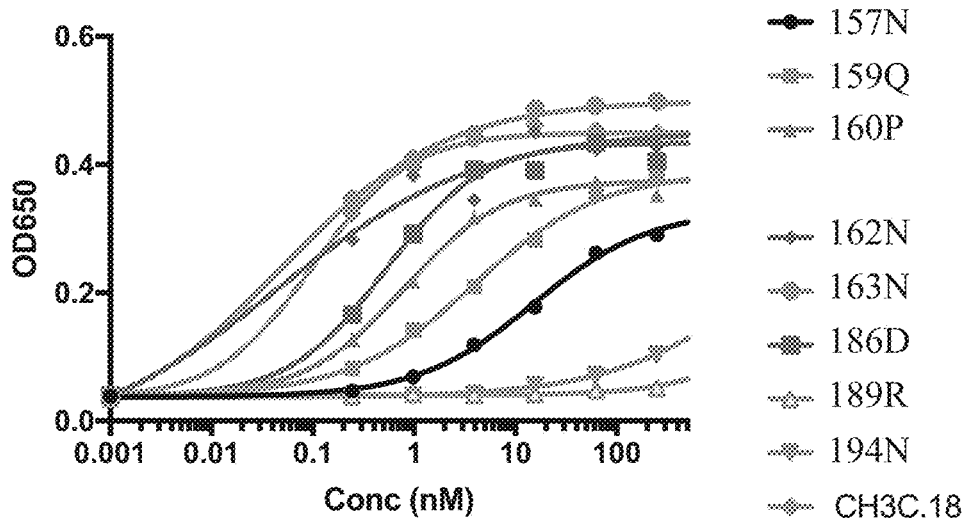
Figure 19A:
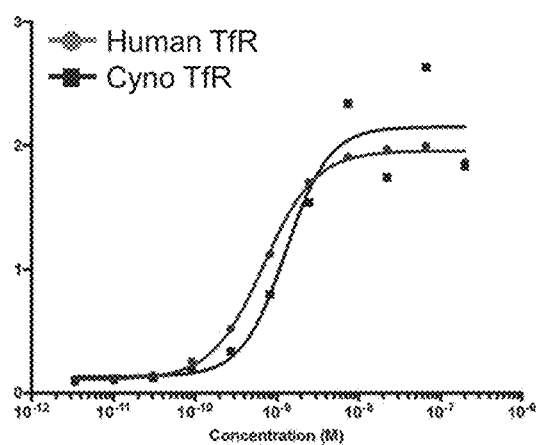
FIGS. 19A-19E show binding ELISAs of CH3C variants from consensus maturation libraries to human or cyno TfR. The new variants (i.e., CH3C.3.2-1, CH3C.3.2-5, and CH3C.3.2-19) had similar binding $EC_{50}$ values to cyno and human TfR, whereas the parental clones CH3C.18 and CH3C.35 had significantly better $EC_{50}$ values for human versus cyno TfR.
Figure 19B:
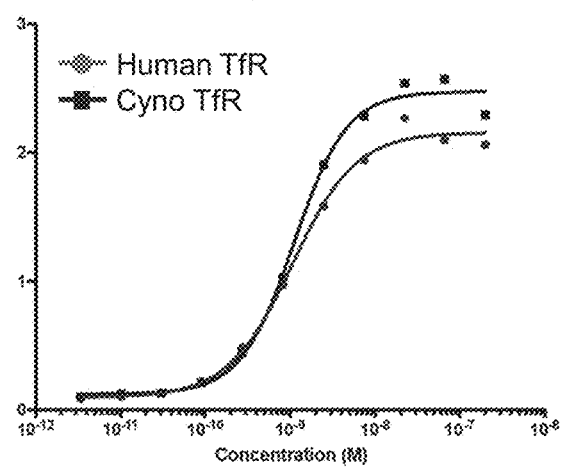
Figure 19C:
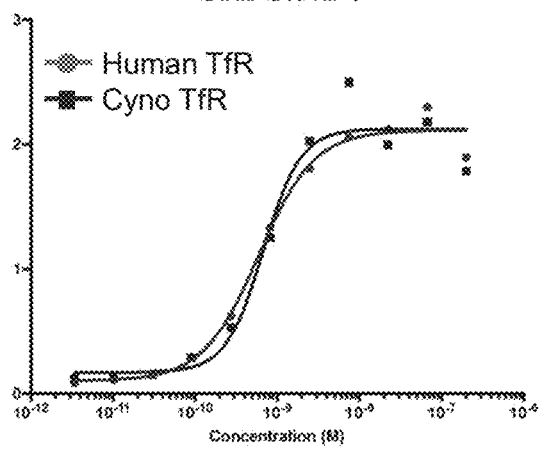
Figure 19D:
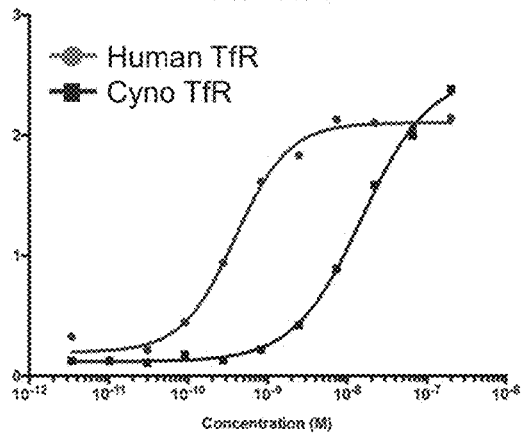
Figure 19E:
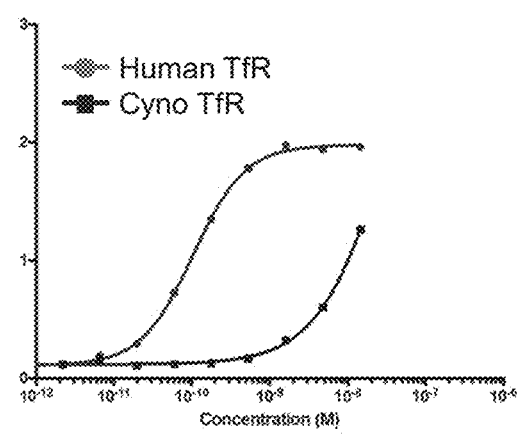

Notably, clone CH3C.35 bound to human TfR about as well as the high affinity anti-Tfr control antibody Ab204. The clones selected from the soft randomization library also had improved cell binding to 293F cells, as shown in FIG. 13. In a similar cell binding assay, these clones were tested for binding to CHO-K1 cells that stably express high levels of human or cyno TfR on their surface. The clones selected from the soft randomization library bound to cells expressing human TfR (FIG. 14A) as well as cyno TfR (FIG. 14B) and did not bind to the parental CHO-K1 cells (FIG. 14C). The magnitude and binding $EC_{50}$ values were substantially lower for cyno TfR as compared to human TfR. Data is summarized in Table 8 below.

TABLE 8

EC$_{50}$ and max. MFI (Median Fluorescence Intensity) values for CH3C clones binding to cells

| Clone | 293F EC50 (nM) | 293F MFI at 200 nM | CHO-huTfR EC$_{50}$ (nM) | CHO-huTf MFI at 200 nM | CHO-cyTfR EC$_{50}$ (nM) | CHO-cyTfR MFI at 200 nM |
|---|---|---|---|---|---|---|
| CH3C.3 | n.d. | 1385 | 6.5 | 10296 | n.d. | 941 |
| CH3C.17 | n.d. | 1556 | 4.2 | 13933 | >50 | 8205 |
| CH3C.18 | 22 | 2100 | 2.3 | 22997 | 6.6 | 9614 |
| CH3C.25 | n.d. | 314 | 17 | 11434 | >50 | 12515 |
| CH3C.35 | 0.67 | 1481 | 2.6 | 22059 | 11 | 8292 |
| CH3C.51 | n.d. | 784 | 27 | 11892 | >50 | 14455 |
| Ab204 | 0.25 | 3404 | 1.8 | 35744 | 2.4 | 41041 |

Epitope Mapping

To determine whether the engineered CH3C Fc regions bound to the apical domain of TfR, TfR apical domain (SEQ ID NOS:107 and 108 for human and cyno, respectively) was expressed on the surface of phage. To properly fold and display the apical domain, one of the loops had to be truncated and the sequence needed to be circularly permuted; the sequences expressed on phage are identified as SEQ ID NOS:109 and 110 for human and cyno, respectively. Clones CH3C.18 and CH3C.35 were coated on ELISA plates and the previously described phage ELISA protocol was followed. Briefly, after washing and blocking with 1% PBSA, dilutions of phage displaying were added and incubated at room temperature for 1 hour. The plates were subsequently washed and anti-M13-HRP was added, and after additional washing the plates were developed with TMB substrate and quenched with 2N H2504. Both CH3C.18 and CH3C.35 bound to the apical domain in this assay.

Since binding to cyno TfR was known to be much weaker than binding to human TfR, it was hypothesized that one or more of the amino acid differences between cyno and human apical domains was likely responsible for the binding difference. Therefore, a series of six point mutations was made in the human TfR apical domain where the human residue was replaced with the corresponding cyno residue. These mutants were displayed on phage and the phage concentrations were normalized by OD$_{268}$ and binding to CH3C.18 and CH3C.35 was tested by phage ELISA titration (FIGS. 16B and 16C). Capture on anti-Myc antibody 9E10 showed that display levels for all mutants were similar (FIG. 16A). Binding to the human TfR mutations clearly showed a strong effect of the R208G mutation, which suggested that this residue is a key part of the epitope and is negatively impacted by the cyno residue at this position. The G208R mutation was made on phage-displayed cyno apical domain and it was shown that this mutation dramatically improved binding to cyno apical domain (FIGS. 16D and 16E). These results show that the CH3C clones bound to the apical domain of TfR and that position 208 was important for binding, while positions 247, 292, 364, 370, and 372 were significantly less important.

Paratope Mapping

Figure 20:
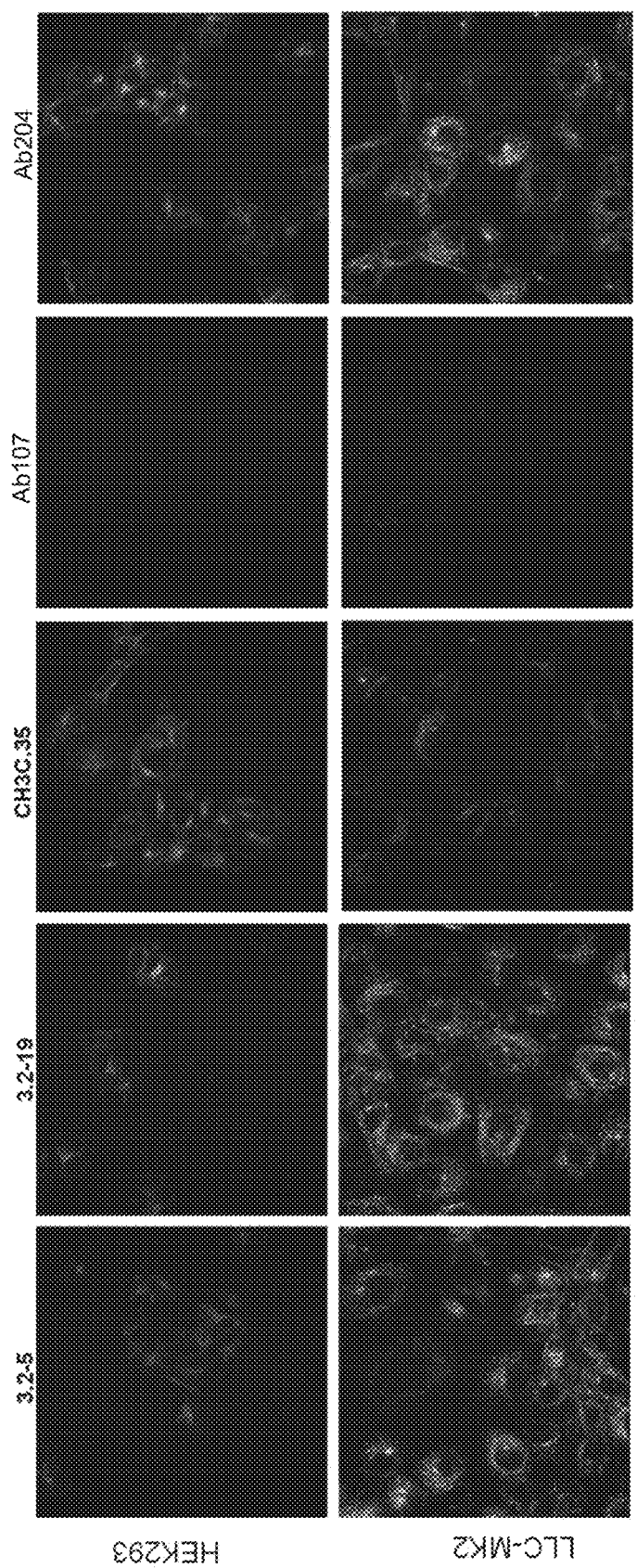
FIG. 20 shows internalization of CH3C variants from consensus maturation libraries in human (HEK293) and monkey (LLC-MK2) cells. Clones CH3C.3.2-5 and CH3C3.2-19, which had similar human and cyno TfR affinities, had significantly improved uptake in monkey cells as compared to clone CH3C.35, which bound better to human TfR. Ab107, an anti-BACE1 antibody, was used as a negative control. (BACE1 is not expressed on HEK293 or MK2 cells). Ab204, an anti-TfR antibody, was used as a positive control.
Figure 21:
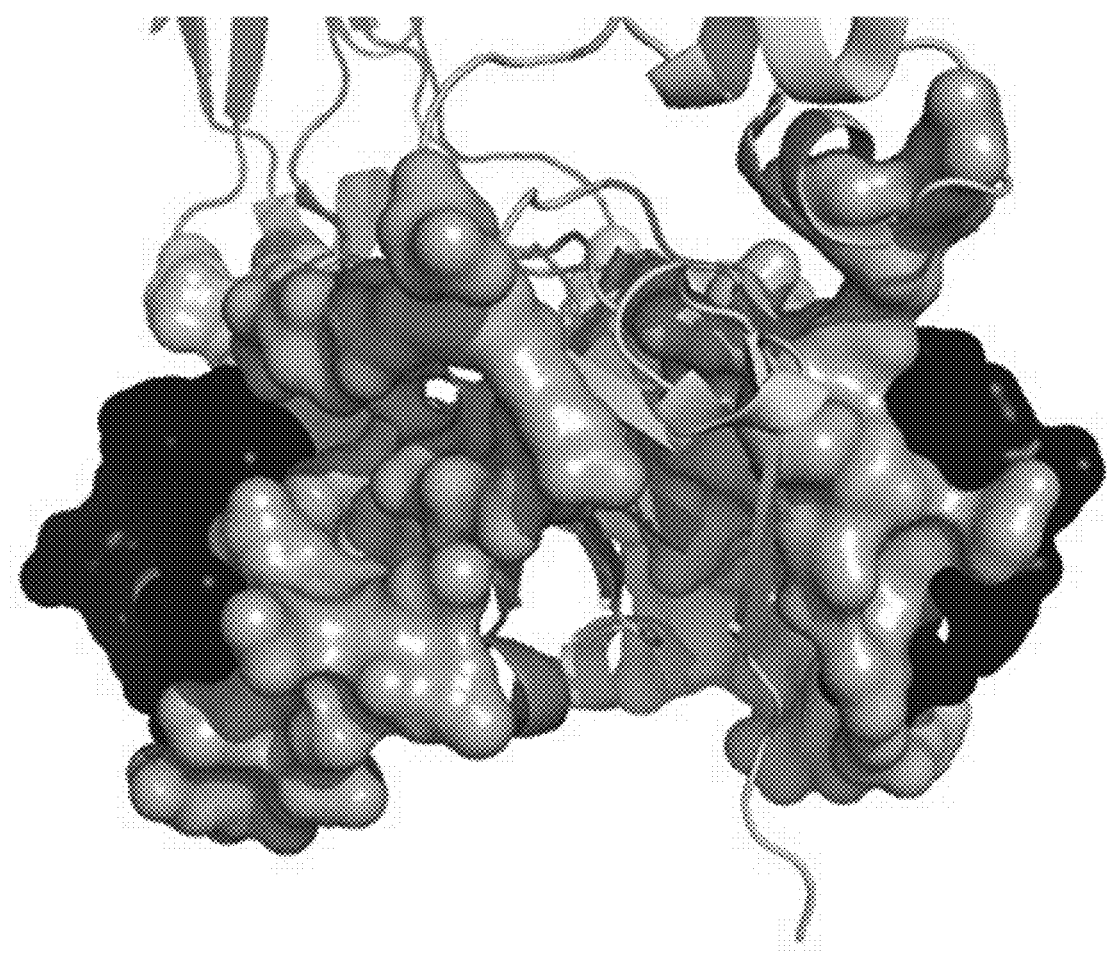
FIG. 21 shows a map of NNK walk residues depicted on the CH3 structure (adapted from PDB 4W4O). Black surfaces show the original CH3C register, grey surfaces show the 44 residues incorporated into the NNK walk structure, and ribbons show the wild-type backbone.
Figure 22:
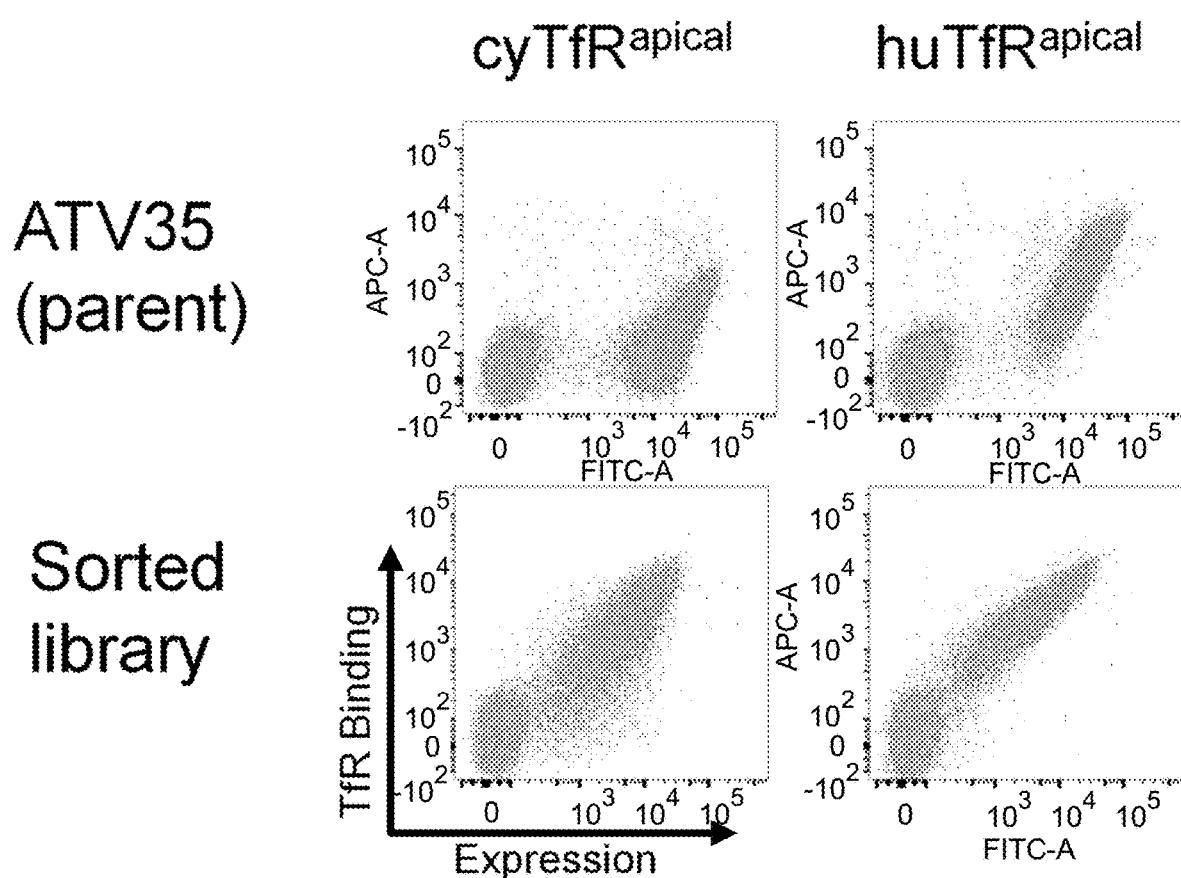
FIG. 22 shows enriched yeast populations after three rounds of sorting the NNK walk library. Yeast were stained with anti-c-Myc to monitor expression (x-axis) and binding to the TfR apical domain (200 nM cyno or 200 nM human) (y-axis). The data presented here clearly show enhanced binding to both TfR apical domain orthologs.
Figure 23A:
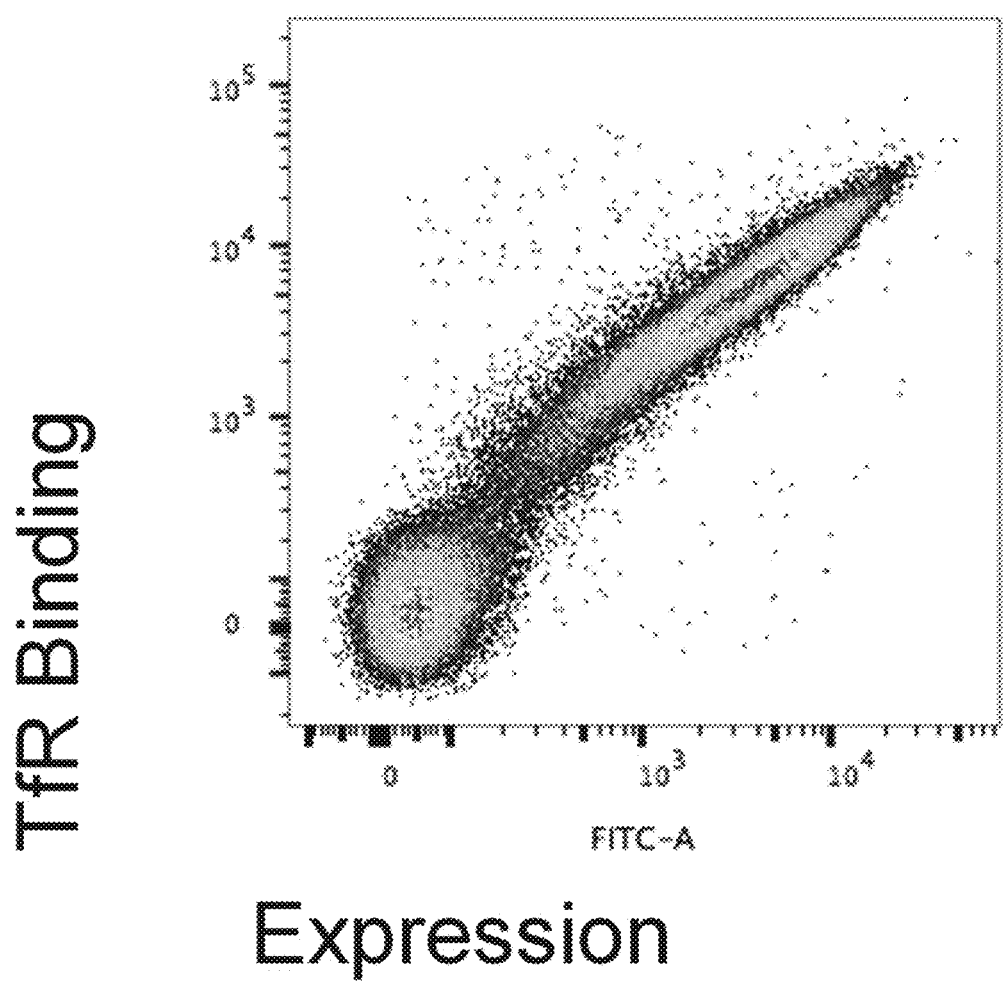
FIGS. 23A and 23B show FACS data for CH3C.35.21 mutants. Yeast were stained with anti-c-Myc to monitor expression (x-axis) and binding to the human TfR apical domain (200 nM) (y-axis).
Figure 23B:
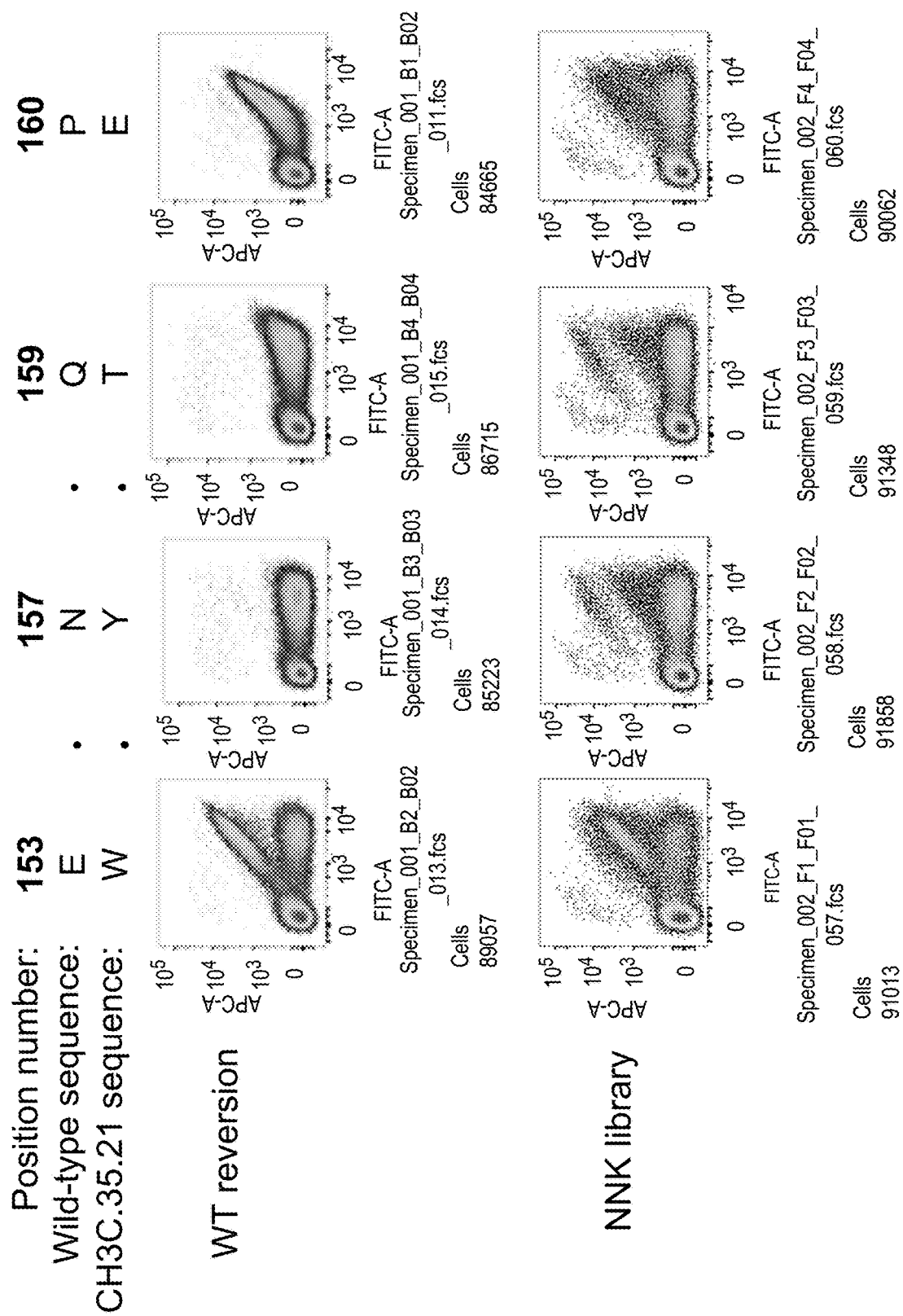
Figure 23B:
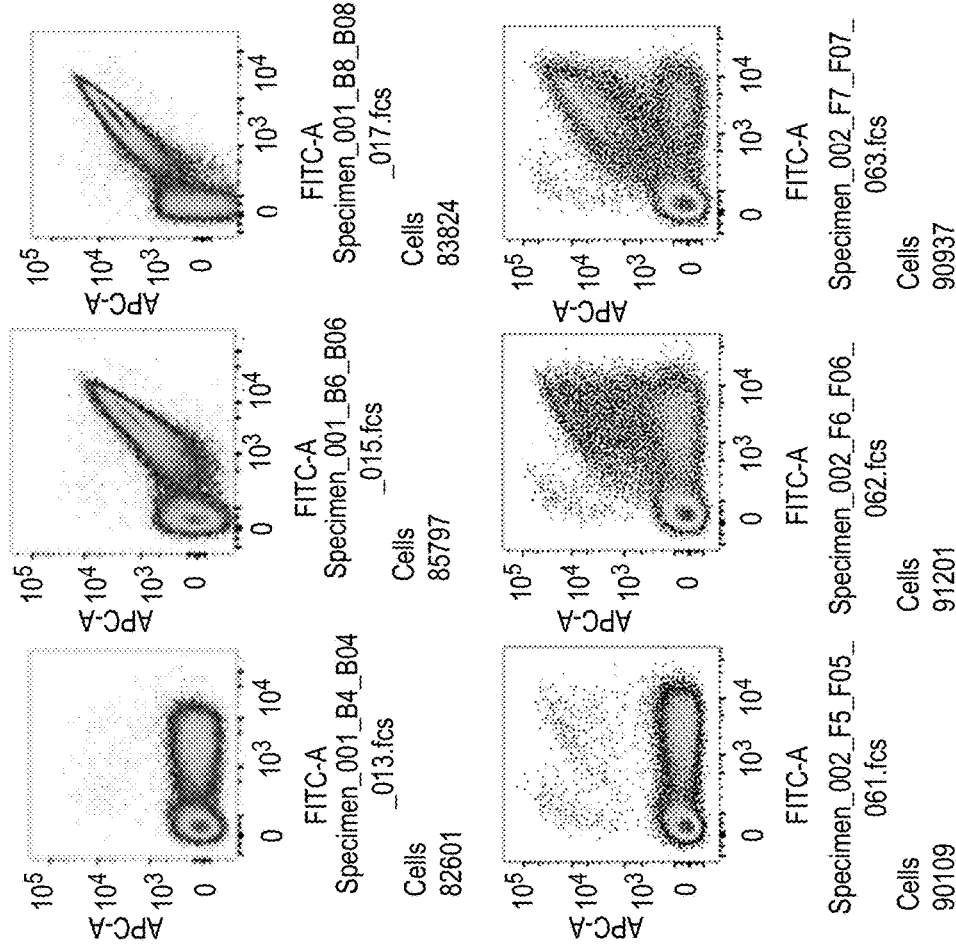
Figure 23B:
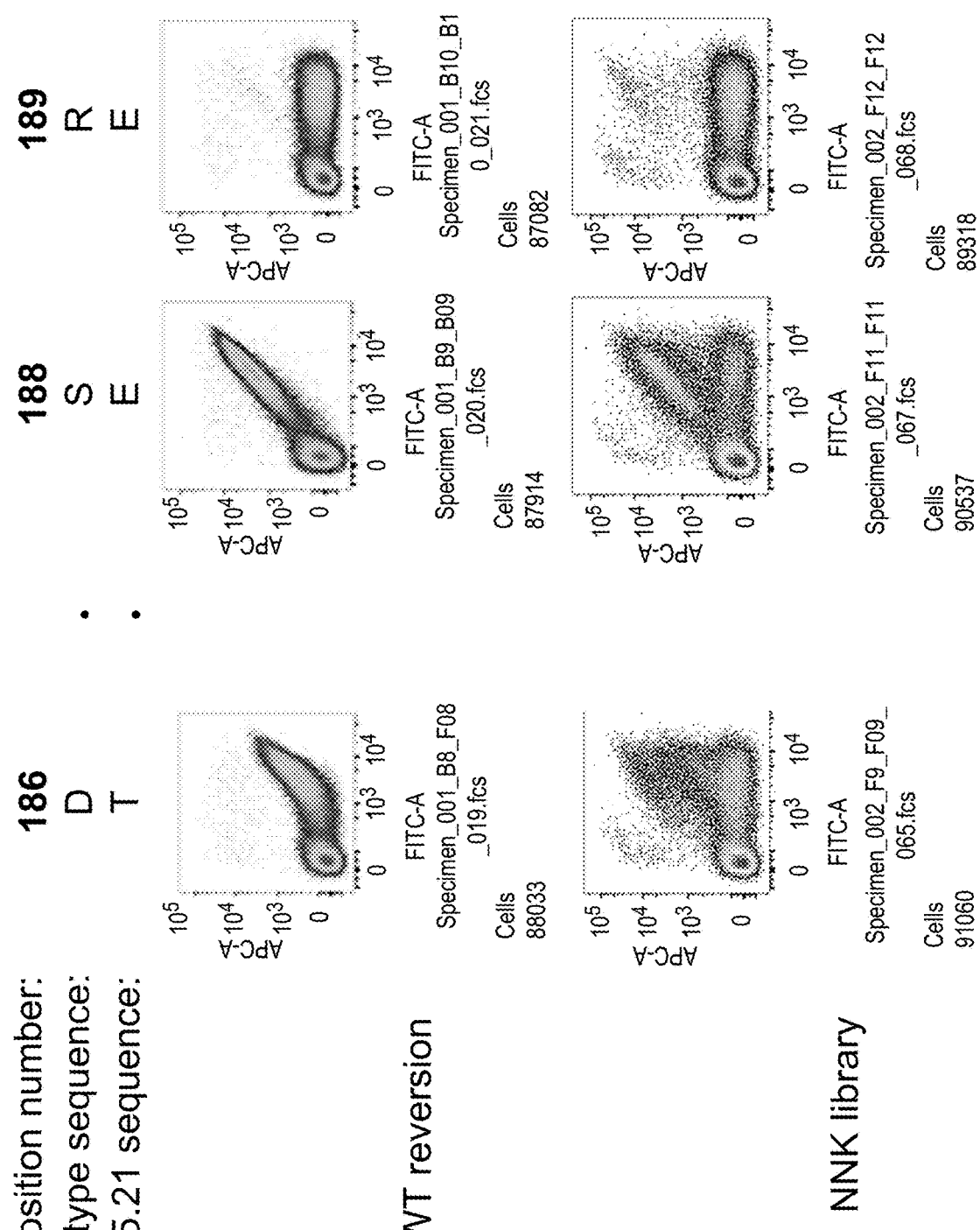
Figure 24A:
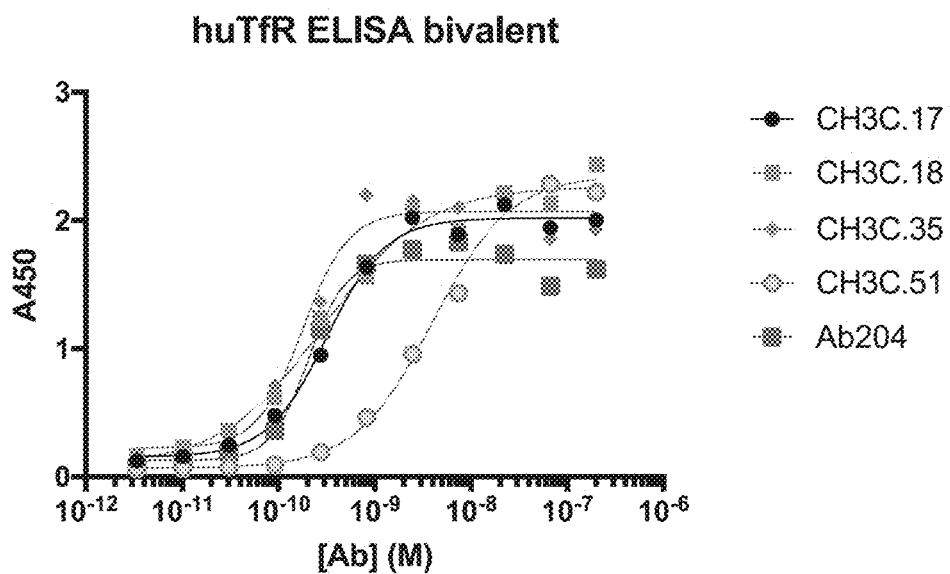
FIGS. 24A-24D show ELISA comparisons of bivalent and monovalent CH3C polypeptide binding to human and cyno TfR.
Figure 24B:
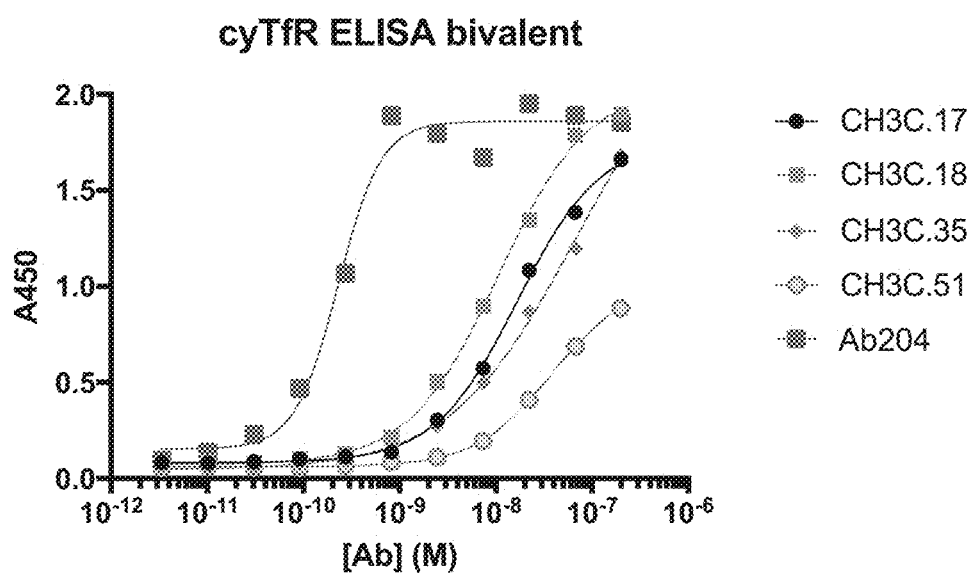
Figure 24C:
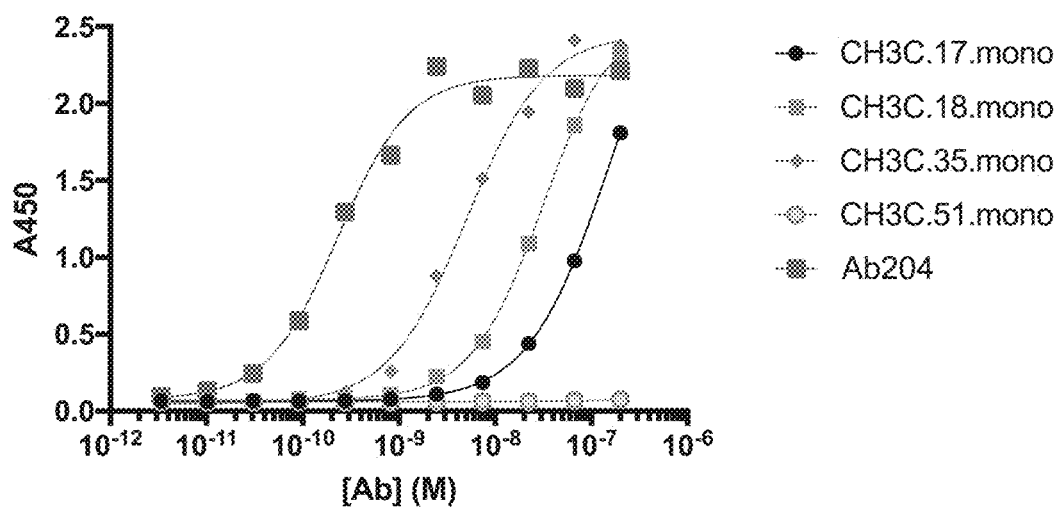
Figure 24D:
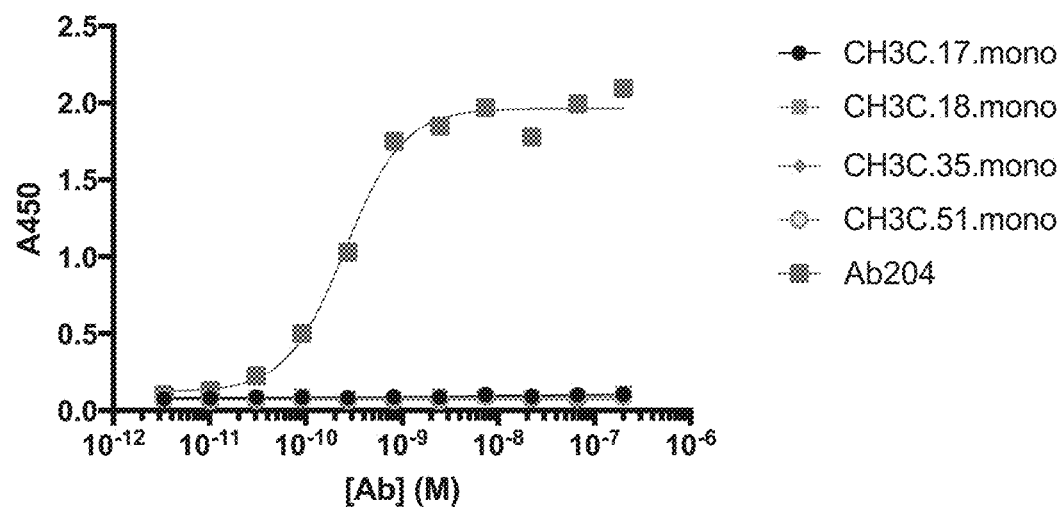
Figure 25A:
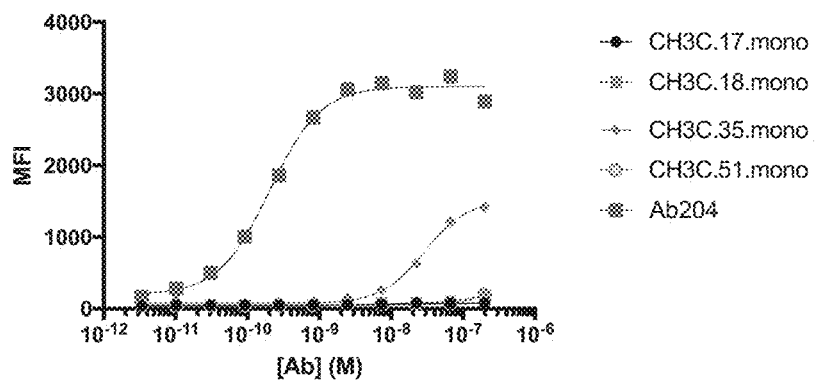
FIGS. 25A-25E show cell binding of monovalent CH3C polypeptides.
Figure 25B:
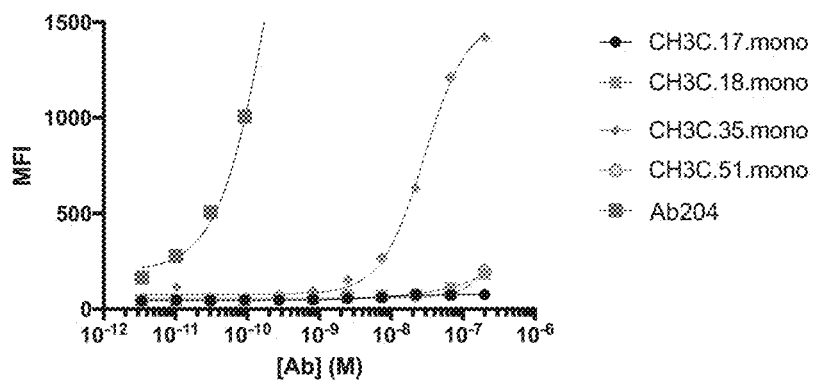
Figure 25C:
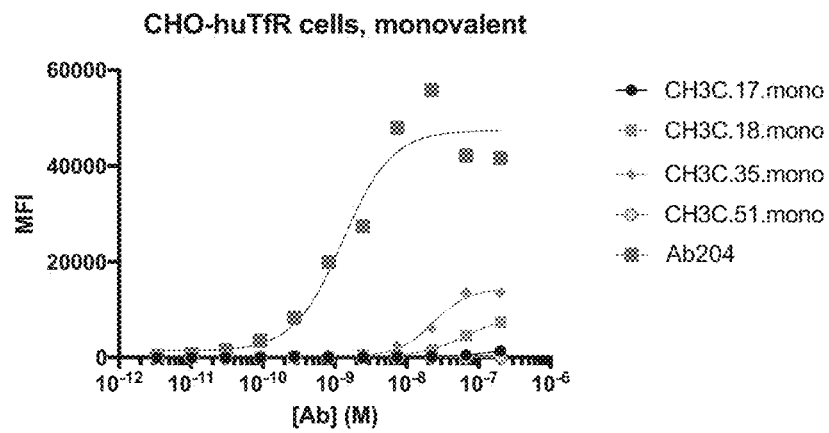
Figure 25D:
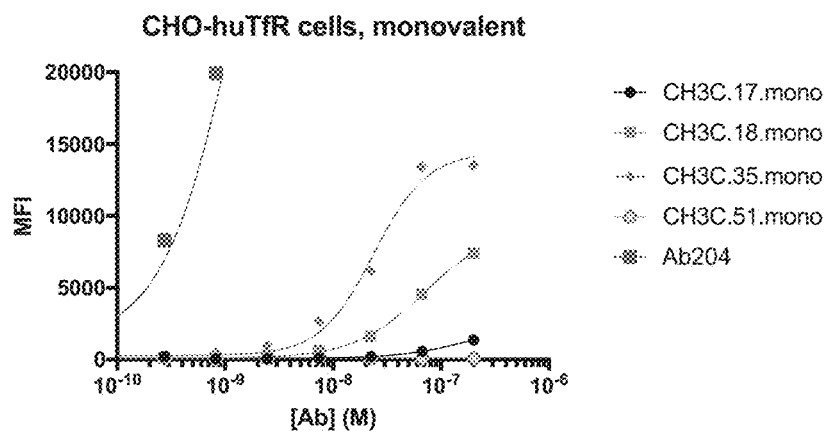
Figure 25E:
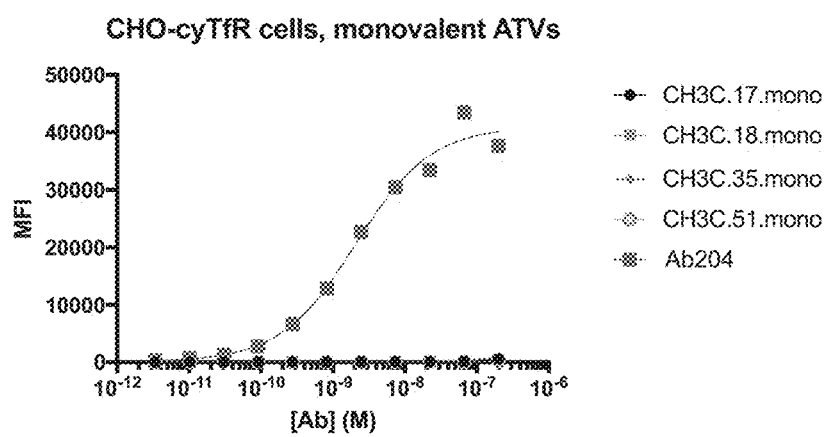
Figure 26:
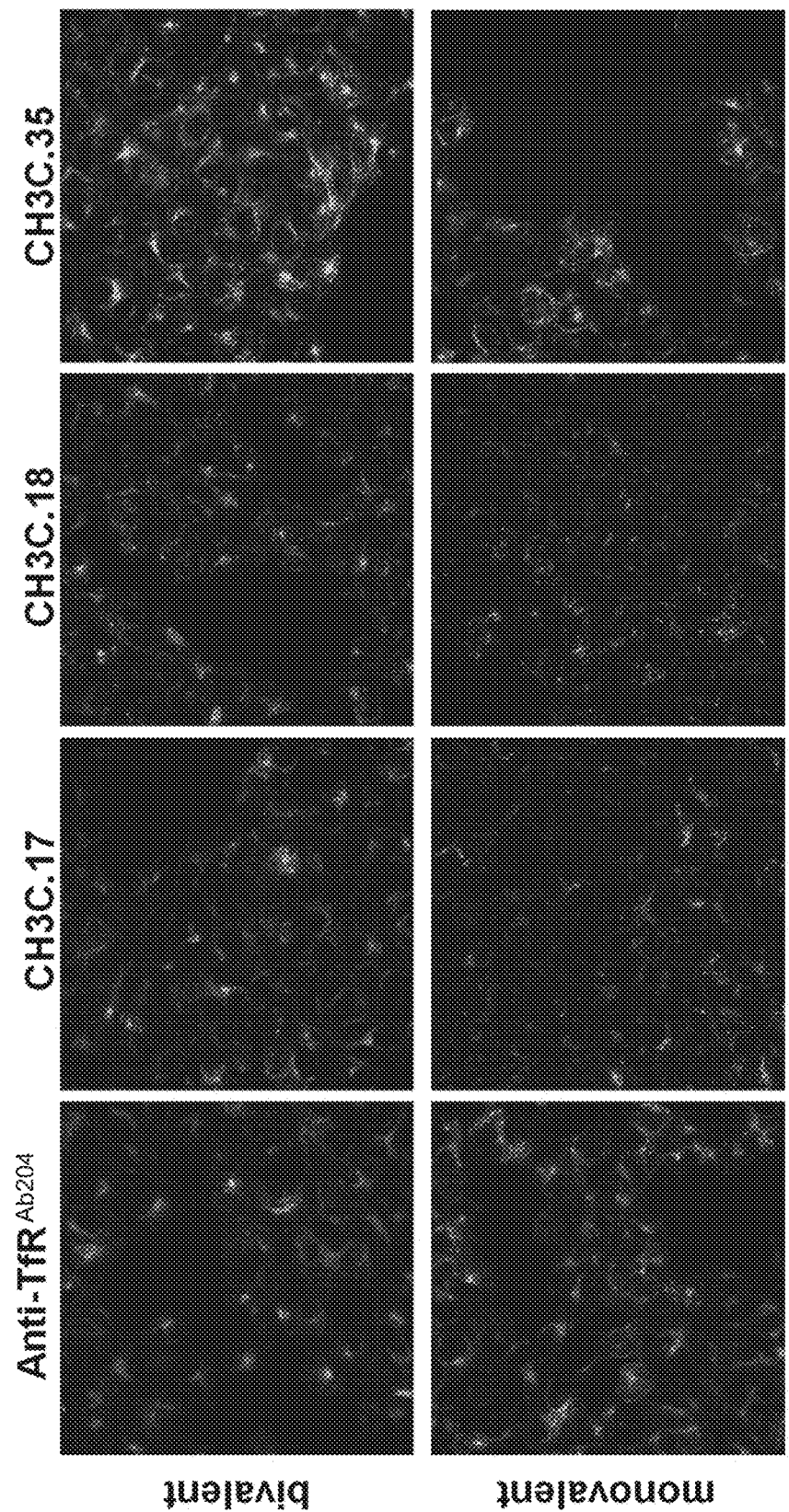
FIG. 26 shows internalization of monovalent and bivalent CH3C polypeptides in HEK293 cells.
Figure 27E:
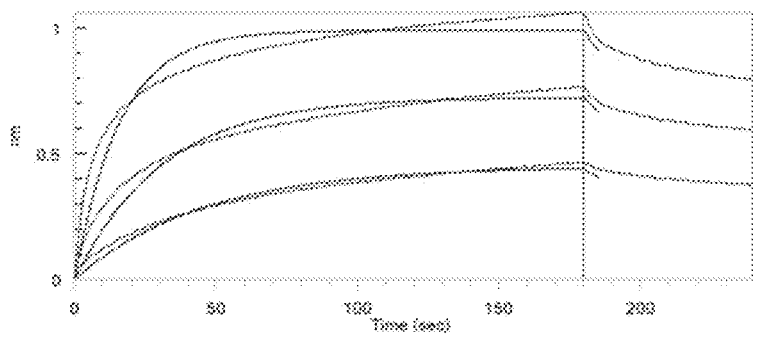
Figure 27F:
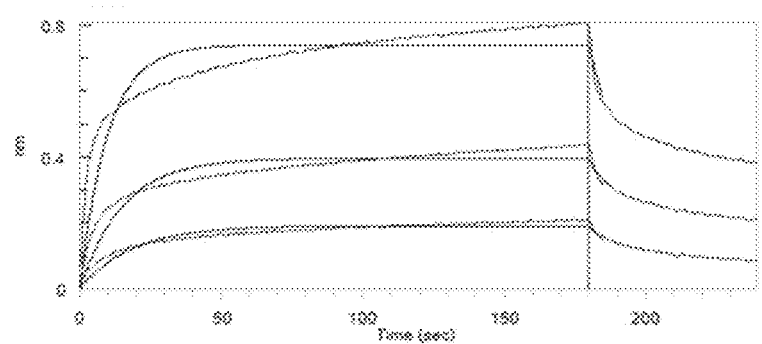
Figure 27G:
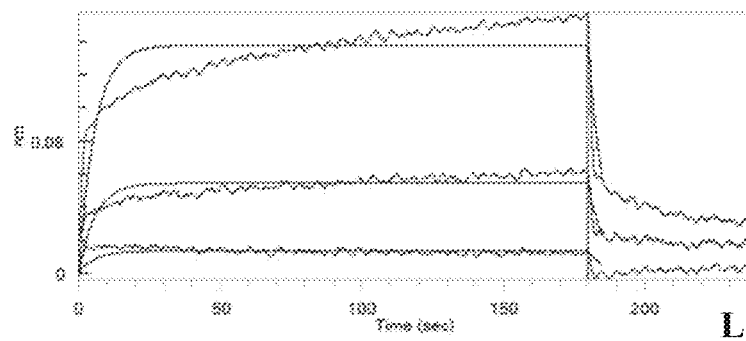
Figure 27H:
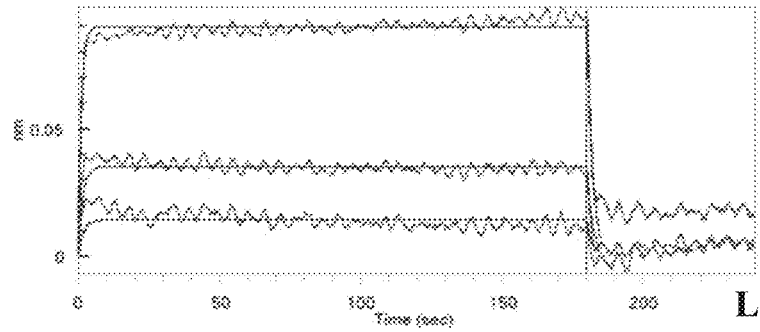
Figure 28A:
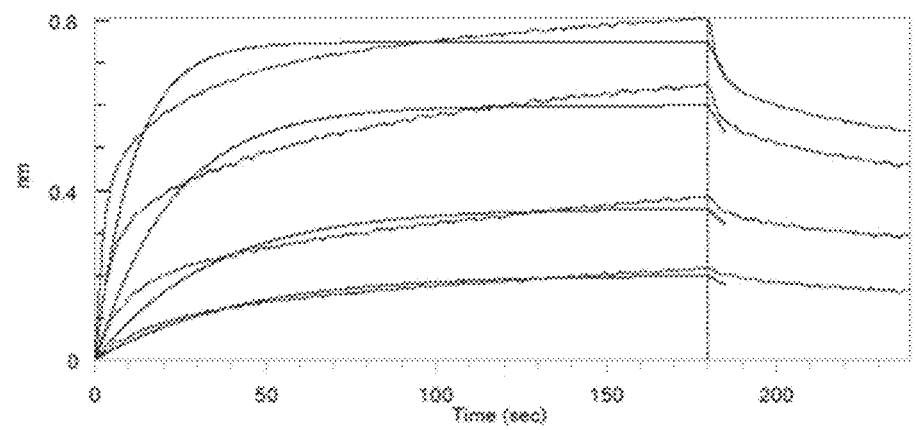
FIGS. 28A-28F show binding kinetics for CH3C polypeptides.
Figure 28B:
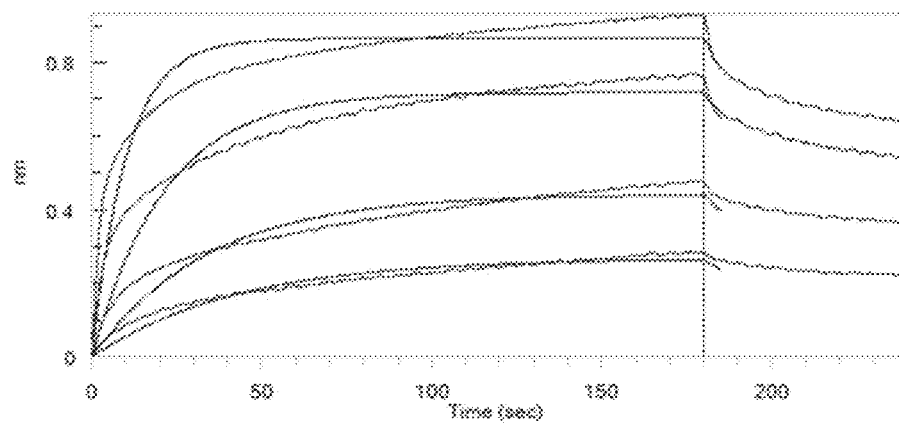
Figure 28C:
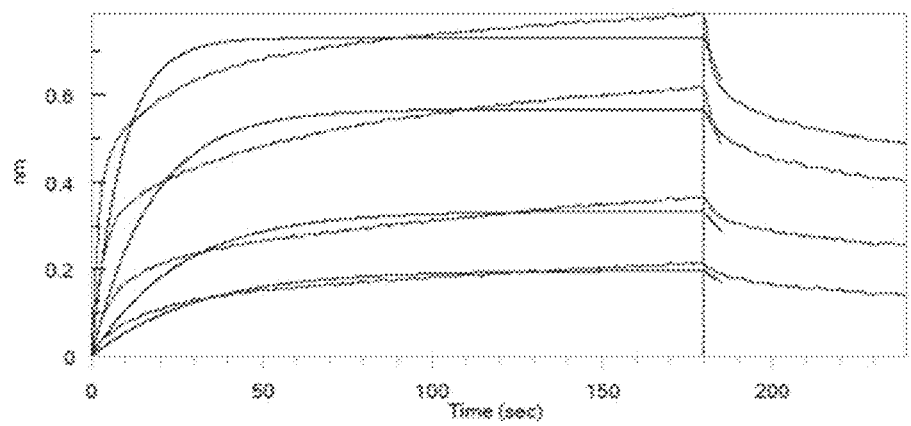
Figure 28D:
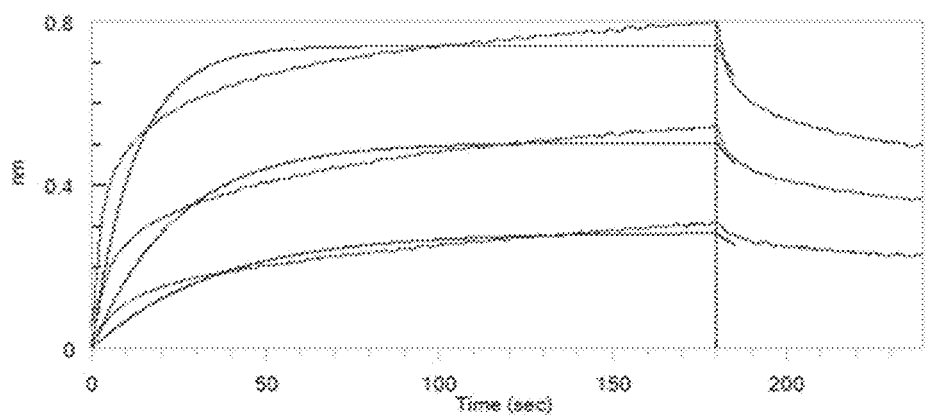
Figure 28E:
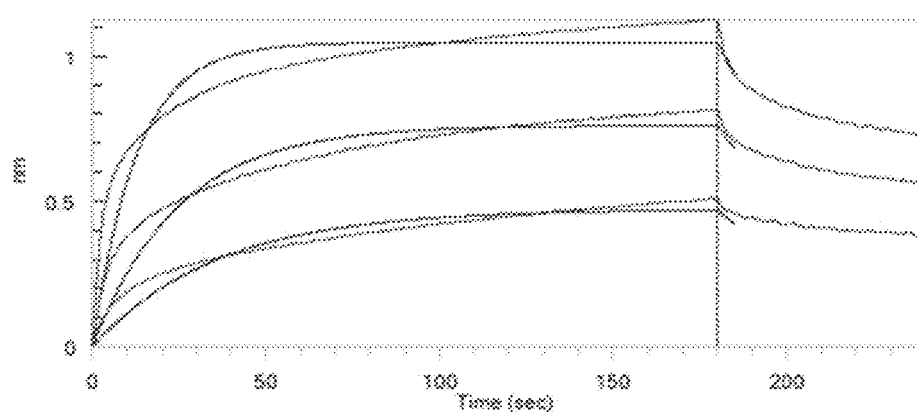
Figure 28F:
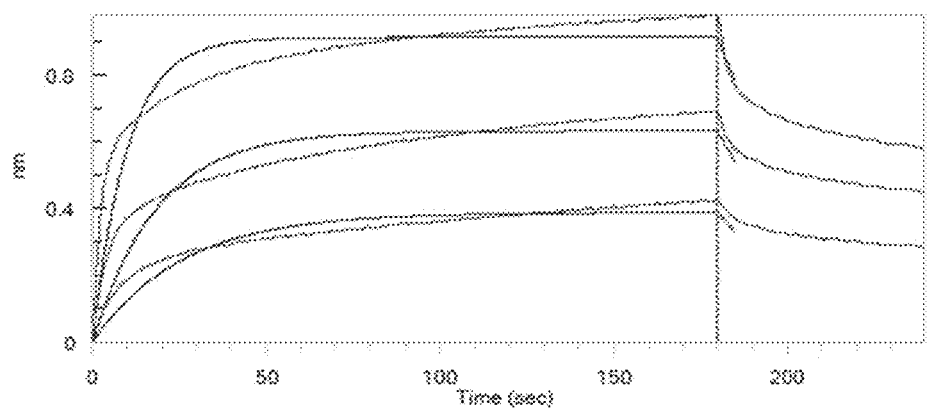

To understand which residues in the Fc domain were most critical for TfR binding, a series of mutant CH3C.18 and CH3C.35 clones was created in which each mutant had a single position in the TfR-binding register mutated back to wild-type. The resulting variants were expressed recombinantly as CH3C Fc-Fab fusions and tested for binding to human or cyno TfR (FIG. 17). For CH3C.35, positions 161 and 194 were absolutely critical for binding; reversion of either of these to wild-type completely ablated binding to human TfR. Surprisingly, reverting position 163 to wild-type provided a dramatic boost to cyno TfR binding, while having little effect on human binding. Conversely, the reversion of residue 163 to wild-type had little effect in CH3C.18, but in this variant reversion of positions 189 and 194 completely abolished binding to human TfR. In both variants, other single reversions had modest (detrimental) impact on human TfR binding, while in many cases binding to cyno TfR was abolished.

Additional Engineering to Improve Binding to Cyno TfR

Additional libraries were prepared to further increase the affinity of the CH3C variants for cyno TfR. These libraries were designed to be of less than about $10^7$ clones in terms of theoretical diversity, so that the full diversity space could be explored using yeast surface display. The design of these libraries is shown in FIG. 18. Four library designs were used; all libraries were generated using degenerate oligos with NNK or other degenerate codon positions, and amplified by overlap PCR, as described above.

The first library was based on the consensus of CH3C.35-like sequences (FIG. 18A). Here, positions 157-161 were held constant as YGTEW (SEQ ID NO:115), while positions 162, 163, 186, 189, and 194 were mutated using saturation mutagenesis.

The second library was based on the consensus of CH3C.18-like sequences (FIG. 18B). Here, position 157 was restricted to Leu and Met, position 159 was restricted to Leu and His, position 160 was held constant as Val, position 161 was restricted to Trp and Gly, position 162 was restricted to Val and Ala, position 163 was fully randomized, position 164 was added to the register and fully randomized, position 186 was soft randomized, position 189 was fully randomized, and position 194 was restricted to aromatic amino acids and Leu.

The third library added new randomized positions to the library (FIG. 18C). Two versions were generated, one each with CH3C.18 and CH3C.35 as the starting register, and then additional positions were randomized by saturation mutagenesis: E153, E155, Y164, S188, and Q192.

The fourth library held certain positions constant for CH3C.18 but allowed variation at other positions, with less bias than the consensus library (FIG. 18D). Positions 160, 161, and 186 were fixed, and positions 157, 159, 162, 163, and 189 were randomized by saturating mutagenesis; position 194 was mutated but restricted to aromatic residues and Leu.

The libraries were selected in yeast for four to five rounds against cynoTfR and single clones were sequenced and converted to polypeptide-Fab fusions, as described above. The greatest enrichment in cynoTfR binding was observed from the second library (i.e., derivatives of the CH3.18 parent), though there was also some loss in huTfR binding.

Binding Characterization of CH3C Maturation Clones

Binding ELISAs were conducted with purified CH3C Fc-Fab fusion variants with human or cyno TfR coated on the plate, as described above. The variants from the CH3C.18 maturation library, CH3C3.2-1, CH3C.3.2-5, and CH3C.3.2-19, bound human and cyno TfR with approximately equivalent $EC_{50}$ values, whereas the parent clone CH3C.18, and CH3C.35, had greater than 10-fold better binding to human versus cyno TfR (FIG. 19).

Next, it was tested whether the new polypeptides internalized in human and monkey cells. Using the protocol previously described above in the section titled "Characterization of first generation CH3C clones," internalization in human HEK293 cells and rhesus LLC-MK2 cells was tested. As shown in FIG. 20, the variants that similarly bound human and cyno TfR, CH3C.3.2-5 and CH3C.3.2-19, had significantly improved internalization in LLC-MK2 cells as compared with CH3C.35.

Additional Engineering of CH3C Clones

Additional engineering to further affinity mature clones CH3C.18 and CH3C.35 involved adding additional mutations to the backbone (i.e., non-register) positions that enhanced binding through direct interactions, second-shell interactions, or structure stabilization. This was achieved via generation and selection from an "NNK walk" or "NNK patch" library. The NNK walk library involved making one-by-one NNK mutations of residues that are near to the paratope. By looking at the structure of Fc bound to FcgRI (PDB ID: 4W40), 44 residues near the original library register, as shown in FIG. 21, were identified as candidates for interrogation. Specifically, the following residues were targeted for NNK mutagenesis: K21, R28, Q115, R117, E118, Q120, T132, K133, N134, Q135, S137, K143, E153, E155, S156, G158, Y164, K165, T166, D172, S173, D174, S176, K182, L183, T184, V185, K187, S188, Q191, Q192, G193, V195, F196, S197, S199, Q211, S213, S215, L216, S217, P218, G219, and K220. The 44 single point NNK libraries were generated using Kunkel mutagenesis, and the products were pooled and introduced to yeast via electroporation, as described above for other yeast libraries.

The combination of these mini-libraries (each of which had one position mutated, resulting in 20 variants) generated a small library that was selected using yeast surface display for any positions that lead to higher affinity binding. Selections were performed as described above, using TfR apical domain proteins (FIG. 22). After three rounds of sorting, clones from the enriched yeast library were sequenced, and several "hot-spot" positions were identified where certain point mutations significantly improved the binding to apical domain proteins. For CH3C.35, these mutations included E153 (mutated to Trp, Tyr, Leu, or Gln) and S188 (mutated to Glu). The sequences of the CH3C.35 single and combination mutants are set forth in SEQ ID NOS:21-23, 236-241, and 297-299. For CH3C.18, these mutations included E153 (mutated to Trp, Tyr, or Leu) and K165 (mutated to Gln, Phe, or His). The sequences of the CH3C.18 single mutants are set forth in SEQ ID NOS:242-247.

The "NNK patch" approach was similar to that described above for the CH3B library, but with patches directly adjacent to the CH3C register. Clone CH3C.35 was used as a starting point and the following libraries were generated:

CH3C-patch1: amino acid positions: K21, R28, Y164, K165, and T166;

CH3C-patch2: amino acid positions: Q115, R117, E118, Q120, and K143;

CH3C-patch3: amino acid positions: T132, K133, N134, Q135, and S137;

CH3C-patch4: amino acid positions: E153, E155, S156, and G158;

CH3C-patch5: amino acid positions: D172, S173, D174, S176, and K182;

CH3C-patch6: amino acid positions: L183, T184, V185, K187, and S188;

CH3C-patch7: amino acid positions: Q191, Q192, G193, V195, and F196;

CH3C-patch8: amino acid positions: S197, S199, Q211, S213, and S215; and

CH3C-patch9: amino acid positions: L216, S217, P218, G219, and K220.

Selections were performed as described above, using TfR apical domain proteins. However, no clones with enhanced binding were identified.

In another aspect, the disclosure features a method for enhancing binding of a modified Fc polypeptide that comprises a non-native binding site to a target (e.g., a transferrin receptor), the method comprising: (a) introducing one or more substitutions at one or more positions within 10 Å (e.g., within 9 Å, 8 Å, 7 Å, 6 Å, 5 Å, 4 Å, 3 Å, 2 Å, or 1 Å) of the non-native binding site; and (b) testing the modified Fc polypeptide for binding the target. Binding properties of the modified Fc polypeptide to the target (e.g., a transferrin receptor) may be determined using available methods in the art, e.g., phage and yeast selection methods, ELISA, surface plasmon resonance (SPR; i.e., using a Biacore™ instrument), and FACS.

In some embodiments, the non-native binding site comprises substitutions at one or more of the following positions: 157, 159, 160, 161, 162, 163, 186, 189, and 194.

In some embodiments, the one or more substitutions at one or more positions within 10 Å of the non-native binding site are selected from the group consisting of K21, R28, Q115, R117, E118, Q120, T132, K133, N134, Q135, S137, K143, E153, E155, S156, G158, Y164, K165, T166, D172, S173, D174, S176, K182, L183, T184, V185, K187, S188, Q191, Q192, G193, V195, F196, S197, S199, Q211, S213, S215, L216, S217, P218, G219, and K220, with reference to SEQ ID NO:1.

Additional Maturation Libraries To Improve CH3C.35 Affinity

An additional library to identify combinations of mutations from the NNK walk library, while adding several additional positions on the periphery of these, was generated as described for previous yeast libraries. In this library, the YxTEWSS and TxxExxxxF motifs were kept constant, and six positions were completely randomized: E153, K165, K187, S188, S197, and S199. Positions E153 and S188 were included because they were "hot spots" in the NNK walk library. Positions K165, S197, and S199 were included because they make up part of the core that may position the binding region, while K187 was selected due to its adjacency to position 188.

This library was sorted, as previously described, with the cyno TfR apical domain only. The enriched pool was sequenced after five rounds, and the sequences of the CH3 regions of the identified unique clones are set forth in SEQ ID NOS:248-265.

Exploration of Acceptable Diversity within the Original Register and Hot Spots for CH3C.35.21

The next libraries were designed to explore the totality of acceptable diversity in the main binding paratope. The approach taken was similar to the NNK walk libraries. Each of the original register positions (157, 159, 160, 161, 162, 163, 186, 189, and 194) plus the two hot spots (153 and 188) were individually randomized with NNK codons to generate a series of single-position saturation mutagenesis libraries on yeast. In addition, each position was individually reverted to the wild-type residue, and these individual clones were displayed on yeast. FIG. 23 shows binding of the parental clone CH3C.35.21 as compared to the wild-type reversions and single-position NNK libraries. It was noted that positions 153, 162, 163, and 188 were the only positions that retained substantial binding to TfR upon reversion to the wild-type residue (some residual but greatly diminished binding was observed for reversion of 186 to wild-type).

The single-position NNK libraries were sorted for three rounds against the human TfR apical domain to collect the top ~5% of binders, and then at least 16 clones were sequenced from each library. The results indicate what amino acids at each position can be tolerated without significantly reducing binding to human TfR, in the context of the CH3C.35 clone. A summary is below:

Position 153: Trp, Leu, or Glu;
Position 157: Tyr or Phe;
Position 159: Thr only;
Position 160: Glu only;
Position 161: Trp only;
Position 162: Ser, Ala, or Val (note that although the wild type Asn residue seems to retain some binding, it did not appear following library sorting);
Position 163: Ser or Asn;
Position 186: Thr or Ser;
Position 188: Glu or Ser;
Position 189: Glu only; and
Position 194: Phe only.

The above residues, when substituted into clone CH3C.35 as single changes or in combinations, represent paratope diversity that retains binding to TfR apical domain. Clones having mutations at these positions are shown in Table 9, and the sequences of the CH3 domains of these clones are set forth in SEQ ID NOS:237-241, 264, and 266-296.

Monovalent Polypeptide-Fab Fusions

Generation of Monovalent TfR-Binding Polypeptide-Fab Fusions

Although Fc domains naturally form homodimers, a series of asymmetric mutations known as "knobs-in-holes" can lead to preferential heterodimerization of two Fc fragments, where one Fc unit has the T139W knob mutation (which corresponds to position 366 using EU numbering scheme) and the other Fc unit has the T139S, L141A, and Y180V hole mutations (positions 366, 368, and 407, respectively using EU numbering scheme). In some embodiments, a modified CH3 domain of the invention comprises a Trp at position 139. In some embodiments, a modified CH3 domain of the invention comprises a Ser at position 139, an Ala at position 141 and a Val at position 180. Heterodimeric TfR-binding polypeptides were expressed in 293 or CHO cells by transient co-transfection of two plasmids (i.e., a knob-Fc and a hole-Fc), while polypeptide-Fab fusions were expressed by transient co-transfection of three plasmids (i.e., a knob-Fc-Fab heavy chain, a hole-Fc-Fab heavy chain, and a common light chain). Purification of secreted heterodimeric polypeptides or polypeptide-Fab fusions was performed identically to that for homodimers (i.e., a two-column purification using Protein A followed by size-exclusion, and then concentration and buffer exchange if required). Mass-spectrometry or hydrophobic interaction chromatography was used to determine the amount of heterodimer versus homodimer (e.g., knob-knob or hole-hole paired Fc's) formed. From typical preps, greater than 95% of polypeptides, and often greater than 98%, were heterodimers. For clarity, all monovalent TfR binders (Fc homodimers) generated in this fashion were named "ZZ.mono" where ZZ was the name of the polypeptide and ".mono" indicated monovalent TfR binding. For heterodimeric polypeptides and polypeptide-Fab fusions, the mutations that conferred TfR binding included the "knob" mutation, whereas a non-TfR-binding Fc region was used with the "hole" region, unless otherwise indicated. In some cases, additional mutations that alter Fc properties were also included in these constructs, such as L7A/L8A, M25Y/S27T/T29E, N207S, or N207S/M201L for modified FcγR or FcRn binding, respectively.

Binding Characterization of CH3C.mono Fc Polypeptides

Binding of monovalent CH3C polypeptides was measured in an ELISA using a modification of the procedure described above. Streptavidin was coated on 96-well ELISA plates overnight at 1 μg/mL in PBS. After washing, the plates were blocked with 1% BSA in PBS, then biotinylated human or cyno TfR was added at 1 μg/mL and incubated for 30 minutes. After additional washing, polypeptides were added to the plates at serial dilutions, and incubated for 1 hour. The plates were washed and secondary antibody (i.e., anti-kappa-HRP, 1:5,000) was added for 30 minutes and the plates were washed again. The plates were developed with TMB substrate and quenched with 2N $H_2SO_4$ and then absorbance at 450 nm was read on a BioTek® plate reader. Results are shown in FIG. 24, which directly compares standard (i.e., bivalent TfR-binding) and monovalent TfR-binding polypeptides. Ab204 is a high affinity anti-TfR control antibody.

Additional testing was performed for binding to 293F cells, which endogenously express human TfR, as well as CHO-K1 cells that were stably transfected with human TfR or cyno TfR (FIG. 25).

In general, substantially reduced binding to human TfR for monovalent polypeptides was observed as compared to bivalent polypeptides, and cyno binding was too weak to be detected in these assays for the monovalent polypeptides.

Next it was tested whether monovalent versions of CH3C polypeptides could internalize in human-TfR expressing HEK293 cells. Methods described above for internalization assays were used. As shown in FIG. 26, which compares bivalent and monovalent polypeptides, the monovalent peptides could also internalize, but the overall signal was weaker than for the respective bivalent versions, presumably due to the loss of binding affinity/avidity.

Kinetics of Binding for CH3C Polypeptides Measured By Biolayer Inferometry

Binding kinetics were determined for several monovalent and bivalent CH3C polypeptide variants, fused to anti-BACE1 Fabs, and compared to their bivalent equivalents using biolayer inferometry (i.e., using an Octet® RED system). TfR was captured on a streptavidin sensor, then CH3C polypeptides were bound and washed off. Sensograms were fitted to a 1:1 binding model; the $K_D$ (app) value for bivalent polypeptides represented avid binding to the TfR dimer. The results are shown in Table 10 and FIGS. 27 and 28.

TABLE 10

Kinetics for CH3C polypeptides using Octet ® Red

| Polypeptide | $K_D$ (app) (nM) [human TfR] | $K_D$ (app) (nM) [cyno TfR] |
|---|---|---|
| CH3C.35.N163 | 67 | 374 |
| CH3C.35.N163.mono | 251 | n.d. |
| CH3C.35 | 59 | 934 |
| CH3C.35.mono | 483 | n.d. |
| CH3C.3.2-1 | 337 | 367 |
| CH3C.3.2-5 | 270 | 385 |
| CH3C.3.2-19 | 367 | 454 | n.d. = not determined due to too low binding signal

The polypeptides that were converted to monovalent format had significantly weaker $K_D$ (app) values, due to loss of avidity. Clones CH3C.3.2-1, CH3C.3.2-5, and CH3C.3.2-

19, which were previously shown to have similar human and cyno TfR binding by ELISA, also had very similar $K_D$ (app) values between human and cyno TfR. An attempt was made to test the monovalent forms of these polypeptides, but the binding in this assay was too weak to calculate kinetic parameters.

Example 3

Binding Characterization of Additional CH3C Variants Using Biacore™

The affinity of clone variants for recombinant TfR apical domain was determined by surface plasmon resonance using a Biacore™ T200 instrument. Biacore™ Series S CM5 sensor chips were immobilized with anti-human Fab (human Fab capture kit from GE Healthcare). 5 pg/mL of polypeptide-Fab fusion was captured for 1 minute on each flow cell and serial 3-fold dilutions of human or cyno apical domain were injected at a flow rate of 30 µL/min at room temperature. Each sample was analyzed with a 45-second association and a 3-minute dissociation. After each injection, the chip was regenerated using 10 mM glycine-HCl (pH 2.1). Binding response was corrected by subtracting the RU from a flow cell capturing an irrelevant IgG at similar density. Steady-state affinities were obtained by fitting the response at equilibrium against the concentration using Biacore™ T200 Evaluation Software v3.1.

To determine the affinity of clone variants for recombinant TfR ectodomain (ECD), Biacore™ Series S CM5 sensor chips were immobilized with streptavidin. Biotinylated human or cyno TfR ECD was captured for 1 minute on each flow cell and serial 3-fold dilutions of clone variants were injected at a flow rate of 30 µL/min at room temperature. Each sample was analyzed with a 45-second association and a 3-minute dissociation. The binding response was corrected by subtracting the RU from a flow cell without TfR ECD at a similar density. Steady-state affinities were obtained by fitting the response at equilibrium against the concentration using Biacore™ T200 Evaluation Software v3.1.

The binding affinities are summarized in Table 11. Affinities were obtained by steady-state fitting.

TABLE 11

Binding affinities for additional CH3C variants

| Clone | Human TfR (µM) | Cyno TfR (µM) | Human apical TfR (µM) | Cyno apical TfR (µM) |
|---|---|---|---|---|
| CH3C.35.19.mono | 0.4 | 5.9 | 0.37 | 5.6 |
| CH3C.35.20.mono | 0.25 | 6.7 | 0.17 | 8 |
| CH3C.35.21.mono | 0.1 | 2.1 | 0.12 | 2.2 |
| CH3C.35.24.mono | 0.29 | 3.3 | 0.23 | 3 |
| CH3C.35.21.11.mono | 0.24 | 4 | 0.13 | 2.2 |
| CH3C.35.21.16.mono | 0.18 | 1.8 | 0.12 | 1.9 |
| CH3C.35.21.17.mono | 0.3 | 2.9 | 0.13 | 2.6 |
| CH3C.35.mono | 0.61 | >10 | 0.61 | >10 |
| CH3C.35.N153.mono | 0.42 | >10 | 0.95 | >10 |
| CH3C.35.bi | 0.22 | >2 | not tested | not tested |
| CH3C.35.N153.bi | 0.37 | 3.3 | not tested | not tested |
| CH3C.3.2-19.bi | 5.2 | 5.6 | not tested | not tested |
| CH3C.35.19.bi | 0.074 | 1.5 | not tested | not tested |
| CH3C.35.20.bi | 0.054 | 1.7 | not tested | not tested |
| CH3C.35.21.bi | 0.049 | 0.7 | not tested | not tested |
| CH3C.35.24.bi | 0.061 | 0.65 | not tested | not tested |

Additional CH3C variants CH3C.35.20.1.1, CH3C.35.23.2.1, CH3C.35.23.1.1, CH3C.35.S413, CH3C.35.23.3.1, CH3C.35.N390.1, and CH3C.35.23.6.1 were created and their binding affinities to human TfR were measured following the same protocol as previously described. The binding affinities of CH3C.35.20.1.1, CH3C.35.23.2.1, CH3C.35.23.1.1, CH3C.35.S413, CH3C.35.23.3.1, CH3C.35.N390.1, and CH3C.35.23.6.1 are 620 nM, 690 nM, 750 nM, 1700 nM, 1900 nM, 2000 nM, and 2100 nM, respectively.

Example 4

Binding Characterization of CH3C Variants to FcRn

FcRn binding assays were performed using a FortéBio® Octet® RED384 instrument using FortéBio® Streptavidin biosensors. Biotinylated recombinant BACE1 was diluted to a concentration of 10 µg/mL in kinetic buffer (obtained from FortéBio®) and captured onto individual biosensors for 1 minute. A baseline was then established for 1 minute in kinetic buffer. 10 µg/mL of the polypeptide-Fab fusions (comprising anti-BACE1 Fab arms) were bound to the sensor tips in the presence or absence of 1 uM human TfR ECD. Recombinant human FcRn (pH5.5) binding to immobilized polypeptide-Fab fusion was analyzed with a 3-minute association and a 3-minute dissociation.

The sensograms obtained from these experiments (FIG. 29), indicate that polypeptide-Fab fusions variants bound to FcRn at acidic pH (pH 5.5) and that TfR binding did not appreciably interfere with FcRn binding.

Example 5

Pharmacokinetic/Pharmacodynamic Characterization of CH3C Variants

This example describes pharmacokinetic/pharmacodynamic (PK/PD) characterization of CH3C variant polypeptides of the present invention in mouse plasma and brain tissue.

Pharmacokinetics of CH3C Variants In Wild-Type Mouse Plasma

Pharmacokinetics (PK) were tested for several CH3C variants in wild-type mice to demonstrate in vivo stability in a model lacking TfR-mediated clearance, as the polypeptide-Fab fusions bind only human TfR and not murine TfR. The study design is shown in Table 12 below. 6-8 week-old C57Bl6 mice were intravenously dosed and in-life bleeds were taken via submandibular-bleeds, at time points as indicated in Table 12. Blood was collected in EDTA plasma tubes, spun at 14,000 rpm for 5 minutes, and then plasma was isolated for subsequent analysis.

TABLE 12

PK study design

| Group | Polypeptide | Time points | N | Dose (IV) |
|---|---|---|---|---|
| 1A/1B | Ab122 | A = 30 min, 24 h, 4 d<br>B = 4 h, 2 d, 7 d | A = 2<br>B = 3 | 12.3 mg/kg |
| 2A/2B | Ab153 | A = 30 min, 24 h, 4 d<br>B = 4 h, 2 d, 7 d | A = 2<br>B = 3 | 11.4 mg/kg |
| 3A/3B | CH3C.35.163 mono (Ab153 fusion) | A = 30 min, 24 h, 4 d<br>B = 4 h, 2 d, 7 d | A = 2<br>B = 3 | 11.4 mg/kg |
| 4A/4B | CH3C.3.2-19 (Ab153 fusion) | A = 30 min, 24 h, 4 d<br>B = 4 h, 2 d, 7 d | A = 2<br>B = 3 | 11.0 mg/kg |
| 5A/5B | CH3C.3.2-5 (Ab153 fusion) | A = 30 min, 24 h, 4 d<br>B = 4 h, 2 d, 7 d | A = 2<br>B = 3 | 10.5 mg/kg |

TABLE 12-continued

PK study design

| Group | Polypeptide | Time points | N | Dose (IV) |
|---|---|---|---|---|
| 6A/6B | CH3C.3.2-1 (Ab153 fusion) | A = 30 min, 24 h, 4 d<br>B = 4 h, 2 d, 7 d | A = 2<br>B = 3 | 10.0 mg/kg |

Ab122 served as an anti-RSV control that has normal PK in mice. Ab153 served as an anti-BACE1 control that has normal PK in mice. The Fab arms of Ab153 were fused to the polypeptides in this study.

Figure 30:
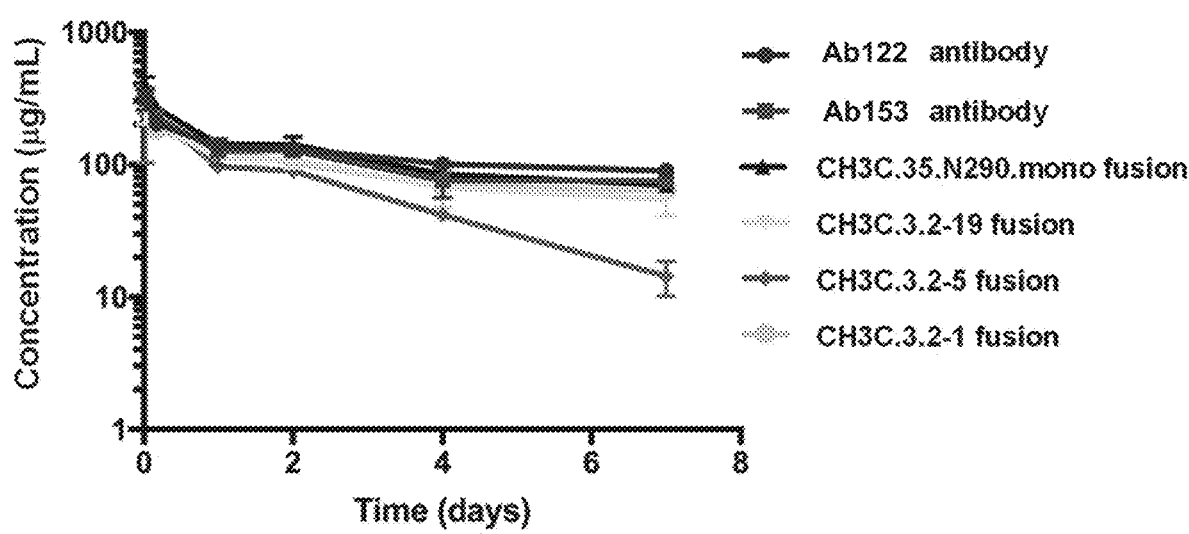
FIG. 30 shows pharmacokinetic (PK) analysis for CH3C polypeptides in wild-type mice. All polypeptide-Fab fusions had comparable clearance to wild-type Fc-Fab fusions (i.e., Ab122, an anti-RSV antibody, and Ab153, an anti-BACE1 antibody) except CH3C.3.2-5, which had faster clearance.

Polypeptide concentrations in mouse plasma were quantified using a generic human IgG assay (MSD® human IgG kit #K150JLD-4) following the manufacturer's instructions. Briefly, precoated plates were blocked for 30 minutes with MSD® Blocker A. Plasma samples were diluted 1:2,500 using a Hamilton® NIMBUS liquid handler and added in duplicate to the blocked plates. Dosing solutions were also analyzed on the same plate to confirm the correct dosage. The standard curve, 0.78-200 ng/mL IgG, was fit using a four-parameter logistic regression. FIG. 30 and Table 13 show the analysis of these data. All of the CH3C polypeptide variants had clearance and half-life values comparable to the standard Ab122, except for CH3C.3.2-5, which had substantially faster clearance and a shorter half-life. Interestingly, this variant was a point mutant of CH3C.3.2-19 (N163D), the latter of which had a normal PK profile.

TABLE 13

PK parameters for CH3C polypeptide-Fab fusions

| Polypeptide | Clearance (mg/day/kg) | Half-life (days) |
|---|---|---|
| Ab122 | 6.12 | 9.12 |
| Ab153 | 9.11 | 4.74 |
| CH3C.35.N163 mono (Ab153 fusion) | 8.44 | 5.35 |
| CH3C.3.2-19 (Ab153 fusion) | 10.3 | 5.42 |
| CH3C.3.2-5 (Ab153 fusion) | 21.0 | 1.90 |
| CH3C.3.2-1 (Ab153 fusion) | 9.25 | 4.65 |

Additional PK Study In Wild-Type Mouse

A second PK study was conducted in wild-type mice according to the study design in Table 14 below (all polypeptide-Fab fusions to Ab153 Fab):

TABLE 14

| Polypeptide | Dose (mg/kg) | Timepoint | n/group |
|---|---|---|---|
| Ab153 | 10 | 0.5 h, 1 d, 4 d, 7 d | 3 |
| CH3C.35.21.mono | 10 | 0.5 h, 1 d, 4 d, 7 d | 3 |
| CH3C.35.24.mono | 10 | 0.5 h, 1 d, 4 d, 7 d | 3 |
| CH3C.35.21.16.mono | 10 | 0.5 h, 1 d, 4 d, 7 d | 3 |
| CH3C.35.21.17.mono | 10 | 0.5 h, 1 d, 4 d, 7 d | 3 |
| CH3C.35.20.bi | 10 | 0.5 h, 1 d, 4 d, 7 d | 3 |
| CH3C.35.21.bi | 10 | 0.5 h, 1 d, 4 d, 7 d | 3 |

Mice and samples were processed as described in the previous study. Data is provided in Table 15.

TABLE 15

Clearance values for CH3C.35 polypeptide-Fab fusions

| Test polypeptide | Clearance (mL/day/kg) |
|---|---|
| Ab153 | 9.53 |
| CH3C.35.21.mono | 8.99 |
| CH3C.35.24.mono | 9.00 |
| CH3C.35.21.16.mono | 11.6 |
| CH3C.35.21.17.mono | 10.9 |
| CH3C.35.20.bi | 7.13 |
| CH3C.35.21.bi | 11.6 |

As is apparent from the clearance values, these polypeptide-Fab fusions exhibited similar clearance in wild-type mice as compared with a standard control antibody.

PK/PD Evaluation of Monovalent CH3C.35.N163 In Wild-Type Mouse Brain Tissue

Transgenic mice expressing human Tfrc apical domain within the murine Tfrc gene were generated using CRISPR/Cas9 technology. The resulting chimeric TfR was expressed in vivo under the control of the endogenous promoter.

Chimeric huTfR$^{apical}$ heterozygous mice (n=4/group) were intravenously dosed with 42 mg/kg of either Ab153 or monovalent CH3C.35.N163, and wild-type mice (n=3) were dosed intravenously with 50 mg/kg of control human IgG1. Ab153 served as a control that has normal PK in mice. All mice were perfused with PBS 24 hours post-dose. Prior to perfusion, blood was collected in EDTA plasma tubes via cardiac puncture and spun at 14,000 rpm for 5 minutes. Plasma was then isolated for subsequent PK and PD analysis. Brains were extracted after perfusion and hemi-brains were isolated for homogenization in 10× by tissue weight of 1% NP-40 in PBS (for PK) or 5 M GuHCl (for PD).

Figure 31:
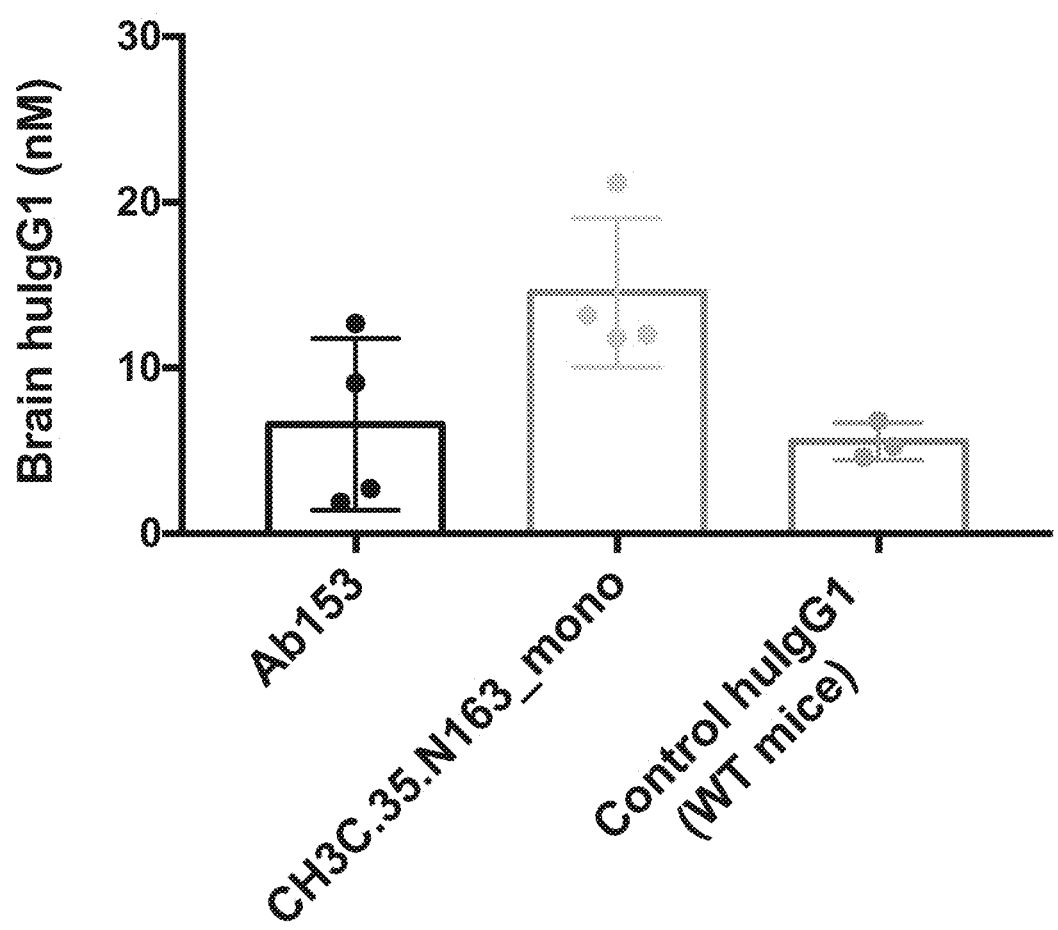
FIG. 31 shows brain pharmacokinetic/pharmacodynamic (PK/PD) data in mouse brain tissue. Chimeric huTfR heterozygous mice (n=4/group) were intravenously dosed with 42 mg/kg of either Ab153 or monovalent CH3C.35.N163 (labeled "CH3C.35.N163_mono"), and wild-type mice (n=3) were dosed intravenously with 50 mg/kg of control human IgG1 (labeled "huIgG1"). Bar graphs represent mean+/−SD.

FIG. 31 shows the results of the brain PK study. Uptake was greater in the monovalent CH3C.35.N163 group than the Ab153 and control human IgG1 groups.

Brain and Plasma PKPD of Polypeptide-Fab Fusions in hTfR$^{apical+/+}$ mice: CH3C.35.21 and CH3C.35.N153

Homozygous hTfR$^{apical+/+}$ mice were intravenously injected with 50 mg/kg of either anti-BACE1 antibody Ab153, anti-TfR/BACE1 bispecific antibody Ab116, CH3C.35.21.mono fused to Ab153 Fab, or CH3C.35.N153.mono fused to Ab153 Fab, as indicated in the study design in Table 16. In this study, all Fc's had LALAPG mutations to remove effector functions.

TABLE 16

Study design for single point brain and plasma PKPD study

| Polypeptide | hTfR affinity (nM) | Dose (mg/kg) | Timepoint (day) | n/group |
|---|---|---|---|---|
| Ab153 | n/a | 50 | 1 | 8 |
| Ab116 | 330 | 50 | 1 | 8 |
| CH3C.35.21.mono | 160 | 50 | 1 | 8 |
| CH3C.35.N153.mono | 370 | 50 | 1 | 8 |

After 24 hours, blood was collected via cardiac puncture and the mice were perfused with PBS. Brain tissue was homogenized in 10×tissue weight of lysis buffer containing 1% NP-40 in PBS. Blood was collected in EDTA tubes to prevent clotting and spun at 14,000 rpm for 7 minutes to isolate plasma. Polypeptide concentrations in mouse plasma and brain lysates were quantified using a generic IgG assay (MSD human IgG kit #K150JLD) following the manufacturer's instructions. Briefly, pre-coated plates were blocked for 30 minutes with MSD Blocker A. Plasma samples were diluted 1:10,000 using a Hamilton Nimbus liquid handler and added in duplicate to the blocked plates. Brain samples were homogenized in 1% NP40 lysis buffer and lysates diluted 1:10 for PK analysis. Dosing solutions were also analyzed on the same plate to confirm the correct dosage. The standard curve, 0.78-200 ng/mL IgG, was fit using a four-parameter logistic regression.

Figure 32B:
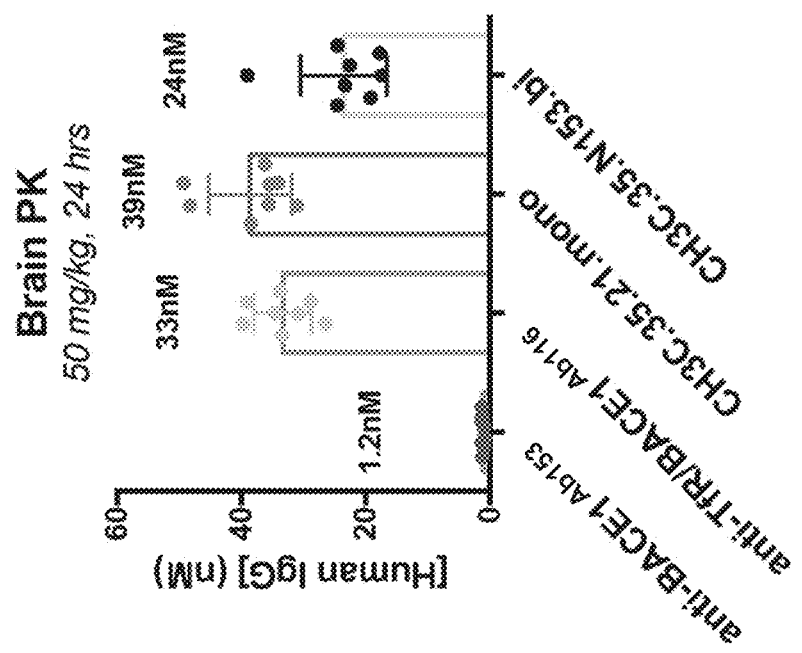
FIGS. 32A and 32B show the concentration of IgG found in hTfR$^{apical+/+}$ mice 24 hours after treatment with polypeptides at 50 mg/kg.
Figure 32A:
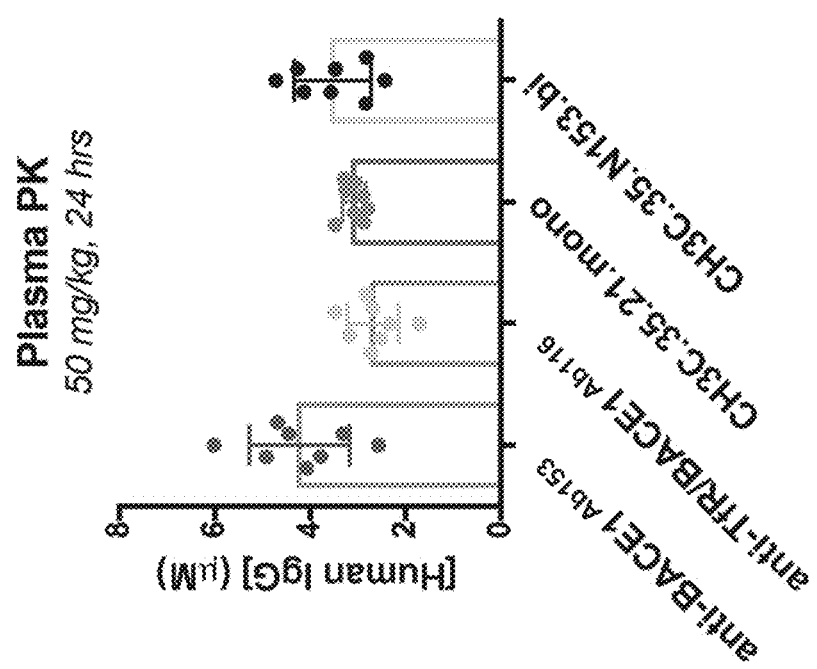

After 24 hours, the plasma levels of TfR-binding polypeptides were lower than the levels for anti-BACE1, likely due to clearance of this antibody via binding to peripherally-expressed hTfR$^{apical}$ (FIG. 32A). In brain, there was a significant increase in the concentration of anti-TfR/BACE1 compared to anti-BACE1 (FIG. 32B). The greatest increase was observed for CH3C.35.21.mono, but brain uptake was also significantly improved as compared to anti-BACE with CH3C35.N153.bi. The significant accumulation of the engineered TfR-binding polypeptides was due to TfR-mediated transcytosis at the blood-brain barrier, thus validating the utility of engineering TfR binding into the Fc region.

BACE1 inhibition of amyloid precursor protein APP cleavage was used as a pharmacodynamic readout of antibody activity in plasma and brain. Brain tissue was homogenized in 10×tissue weight of 5 M guanidine-HCl and then diluted 1:10 in 0.25% casein buffer in PBS. Mouse Aβ40 levels in plasma and brain lysate were measured using a sandwich ELISA. A 384-well MaxiSorp plate was coated overnight with a polyclonal capture antibody specific for the C-terminus of the Aβ40 peptide (Millipore #ABN240). Casein-diluted guanidine brain lysates were further diluted 1:2 on the ELISA plate and added concurrently with the detection antibody, biotinylated M3.2. Plasma was analyzed at a 1:5 dilution. Samples were incubated overnight at 4° C. prior to addition of streptavidin-HRP followed by TMB substrate. The standard curve, 0.78-50 pg/mL msAβ40, was fit using a four-parameter logistic regression.

Plasma amyloid beta-protein (Abeta) was reduced to a similar extent for all polypeptides, as compared to untreated wild-type mice (FIG. 33A), due to the presence of anti-BACE1 Fab arms on all polypeptides. Compared to anti-BACE1, treatment with TfR-binding polypeptides resulted in an increased reduction of Abeta in hTfR$^{apical+/+}$ mice, indicating BACE1 target engagement in the brain was achieved (FIG. 33B). The level of target engagement in brain was similar for the engineering polypeptide fusions and the anti-TfR/BACE1 bispecific antibody.

Brain and plasma PKPD of polypeptide-Fab fusions in hTfR$^{apical+/+}$ mice: CH3C.35.21, CH3C.35.20, CH3C.35, CH3C.35.23, CH3C.35.23.3

Figure 44A:
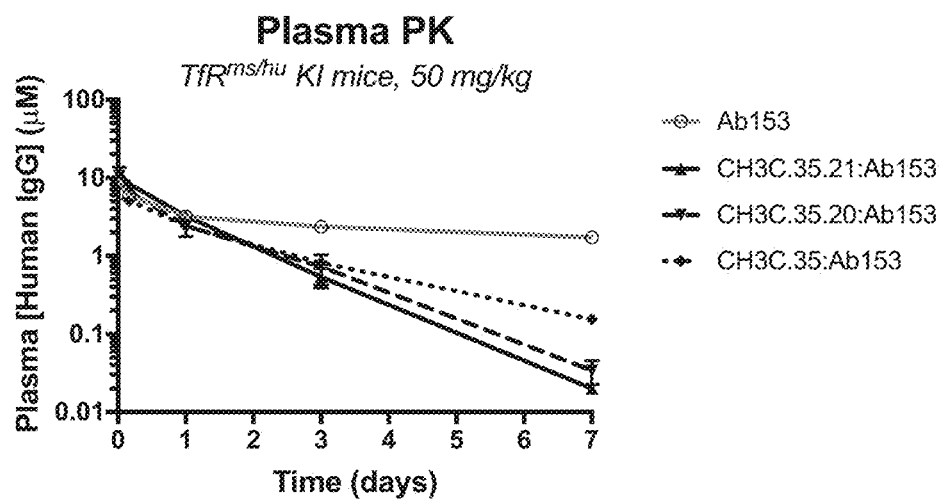
FIGS. 44A and 44B depict huIgG1 concentrations in plasma (FIG. 44A) and brain lysates (FIG. 44B) of hTfRapical$^{+/+}$ knock-in (KI) mice after a single 50 mg/kg systemic injection of anti-BACE1_Ab153, CH3C35.21:Ab153, CH3C35.20:Ab153, or CH3C35:Ab153 polypeptide fusion (mean±SEM, n=5 per group).
Figure 44B:
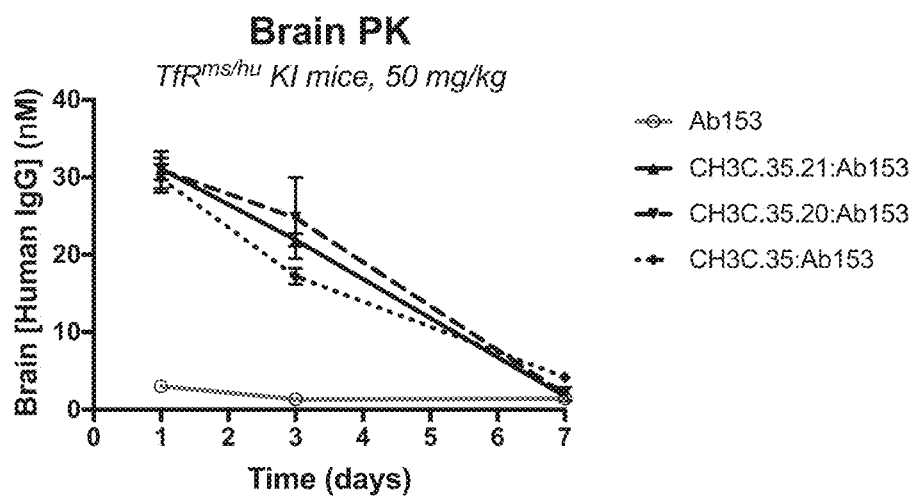
Figure 44C:
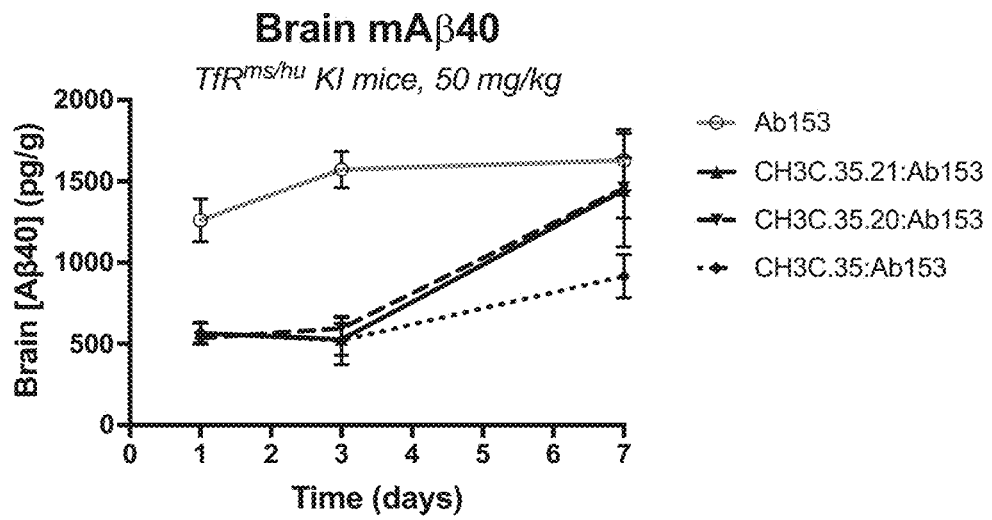
FIG. 44C depicts endogenous mouse Aβ concentration in brain lysate of hTfRapical$^{+/+}$ KI mice after a single 50 mg/kg systemic injection of anti-BACE1_Ab153, CH3C35.21: Ab153, CH3C35.20:Ab153, or CH3C35:Ab153 polypeptide fusion (mean±SEM, n=5 per group).
Figure 44D:
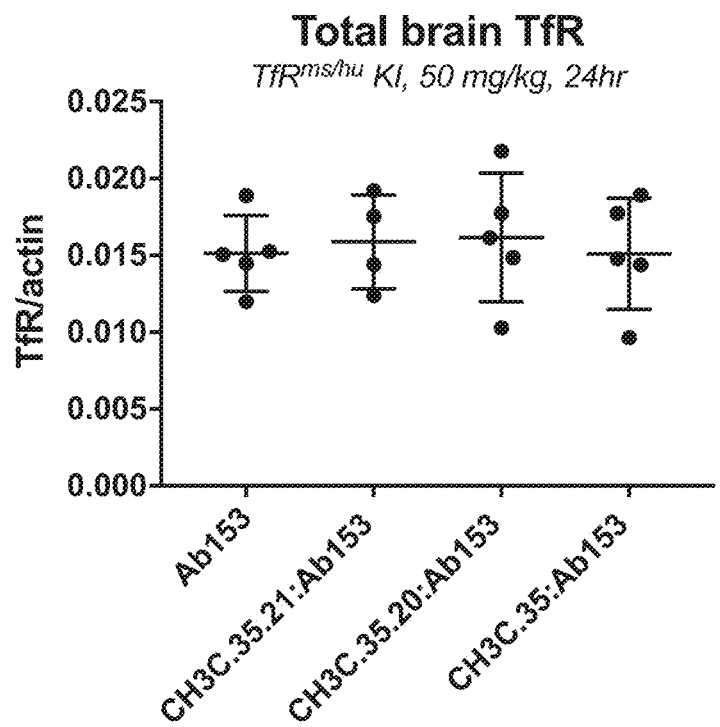
FIG. 44D depicts Western blot quantification of brain TfR protein normalized to actin in brain lysate of hTfR$^{apical+/+}$ KI mice after a single 50 mg/kg systemic injection of anti-BACE1_Ab153, CH3C35.21:Ab153, CH3C35.20:Ab153, or CH3C35:Ab153 polypeptide fusion (mean±SEM, n=5 per group).

To evaluate the impact of TfR binding affinity for PK and brain uptake, anti-BACE1_Ab153 and TfR-binding polypeptide fusions (CH3C.35.21:Ab153, CH3C.35.20:Ab153, CH3C.35:Ab153 fusions) were generated that differed in their binding affinity to apical human TfR as measured by Biacore. The binding affinities of CH3C.35.21:Ab153, CH3C.35.20:Ab153, CH3C.35:Ab153 fusions to human TfR are 100 nM, 170 nM and 620 nM, respectively. hTfRapical$^{+/+}$ knock-in mice were systemically administered either Ab153 or the polypeptide-Fab fusions at 50 mg/kg, and plasma PK and brain PKPD was evaluated at 1, 3, and 7 days post-dose. Brain and plasma PKPD analysis was conducted as described in the previous section. Due to expression of TfR on peripheral tissues, CH3C.35.21:Ab153, CH3C.35.20:Ab153, and CH3C.35:Ab153 fusions exhibited faster clearance in plasma as compared to Ab153 alone, consistent with target-mediated clearance and indicative of in vivo TfR binding (FIG. 44A). Impressively, brain concentrations of CH3C.35.21:Ab153, CH3C.35.20:Ab153, and CH3C.35:Ab153 fusions were significantly increased compared to Ab153, achieving a maximum brain concentration of more than 30 nM at 1 day post-dose, compared to only about 3 nM for Ab153 at this same time point (FIG. 44B). The increase in brain exposure of CH3C.35.21:Ab153, CH3C.35.20:Ab153, and CH3C.35:Ab153 fusions resulted in about 55-60% lower endogenous mouse Aβ levels in brains of mice compared to Aβ levels in mice dosed with Ab153 (FIG. 44C). The lower brain Aβ levels were sustained while concentrations of CH3C.35.21:Ab153, CH3C.35.20:Ab153, and CH3C.35:Ab153 fusions remained elevated in brain, and returned to levels similar to Ab153 treated mice at when exposure was reduced by day 7. The reduction in brain exposure over time correlated with a reduction in peripheral exposure of CH3C.35.21:Ab153, CH3C.35.20:Ab153, and CH3C.35:Ab153 fusions, providing a clear PK/PD relationship in vivo (compare FIGS. 44A and 44C). Additionally, total brain TfR levels were comparable for Ab153-treated and polypeptide-Fab fusion-treated mice after this single high dose, indicating no significant impact of increased brain exposure of the polypeptide-Fab fusions to TfR expression in brain (FIG. 44D).

Figure 45A:
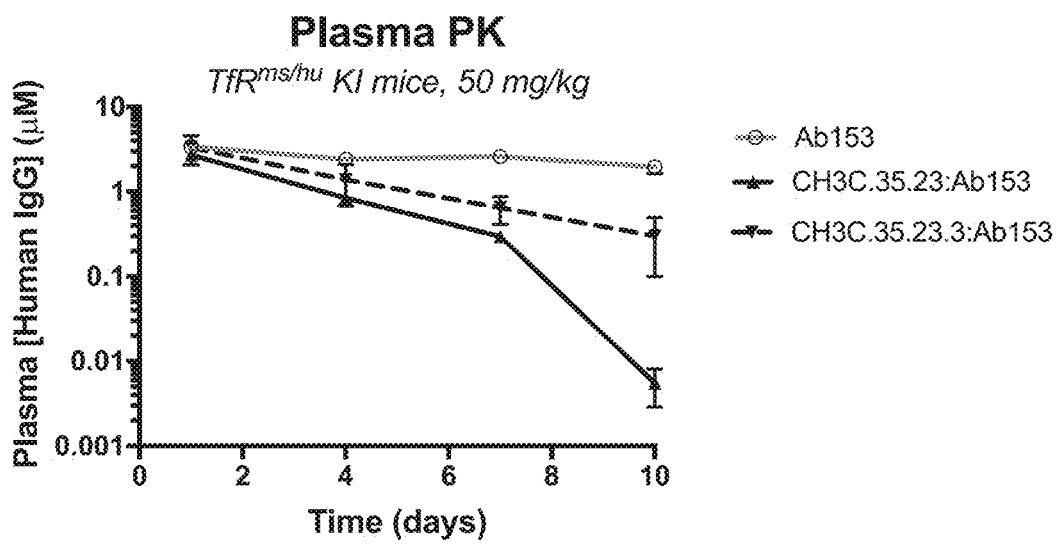
FIGS. 45A and 45B depict huIgG1 concentrations in plasma (FIG. 45A) and brain lysates (FIG. 45B) of hTfR$^{apical+/+}$ KI mice after a single 50 mg/kg systemic injection of anti-BACE1_Ab153, CH3C.35.23:Ab153, or CH3C.35.23.3:Ab153 polypeptide fusion (mean±SEM, n=5 per group).
Figure 45B:
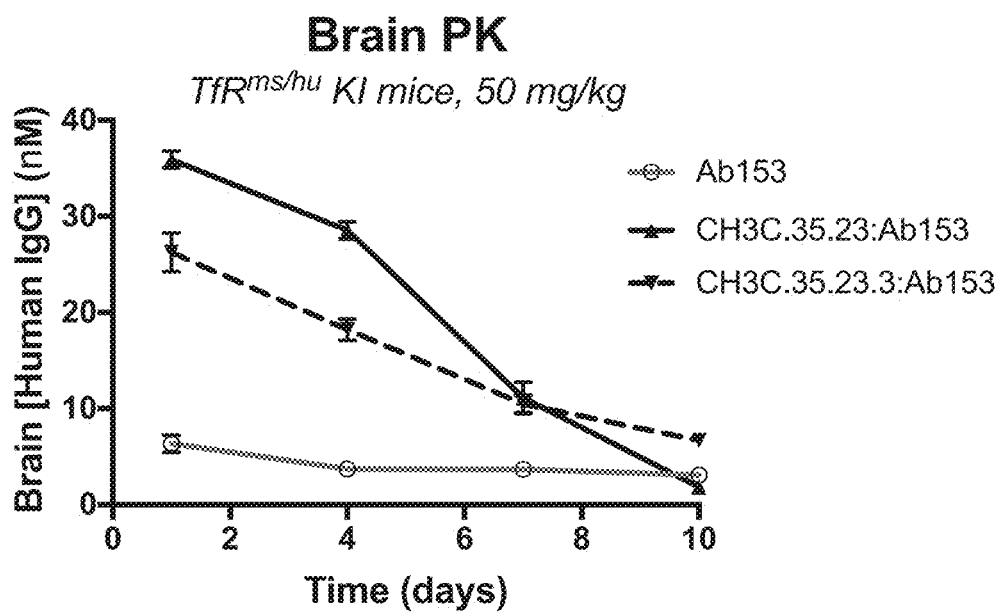
Figure 45C:
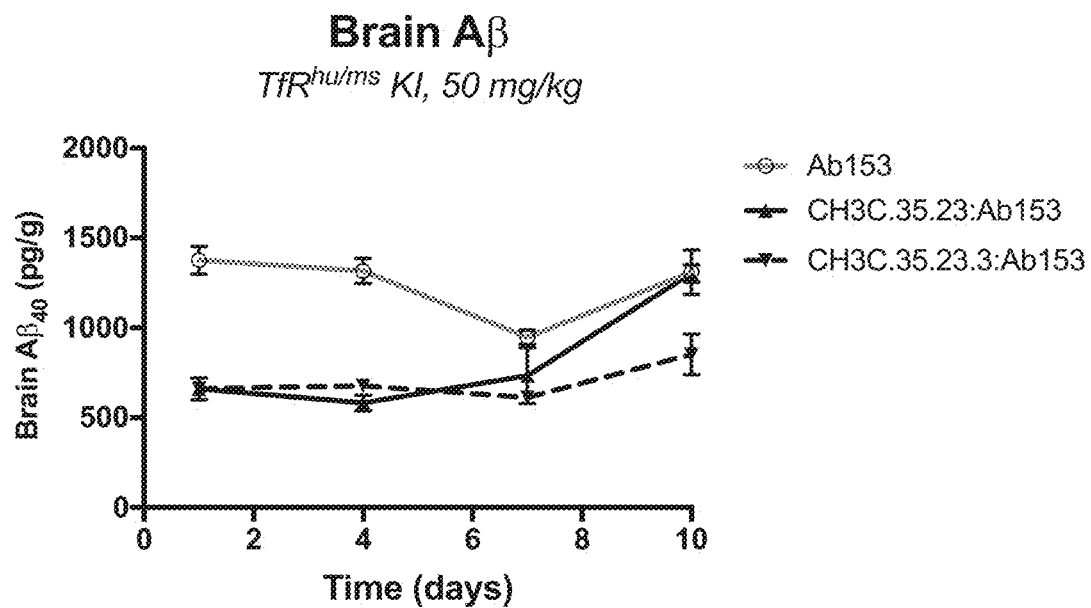
FIG. 45C depicts endogenous mouse Aβ concentration in brain lysate of hTfR$^{apical+/+}$ KI mice after a single 50 mg/kg systemic injection of anti-BACE1_Ab153, CH3C.35.23: Ab153, or CH3C.35.23.3:Ab153 polypeptide fusion (mean±SEM, n=5 per group).
Figure 45D:
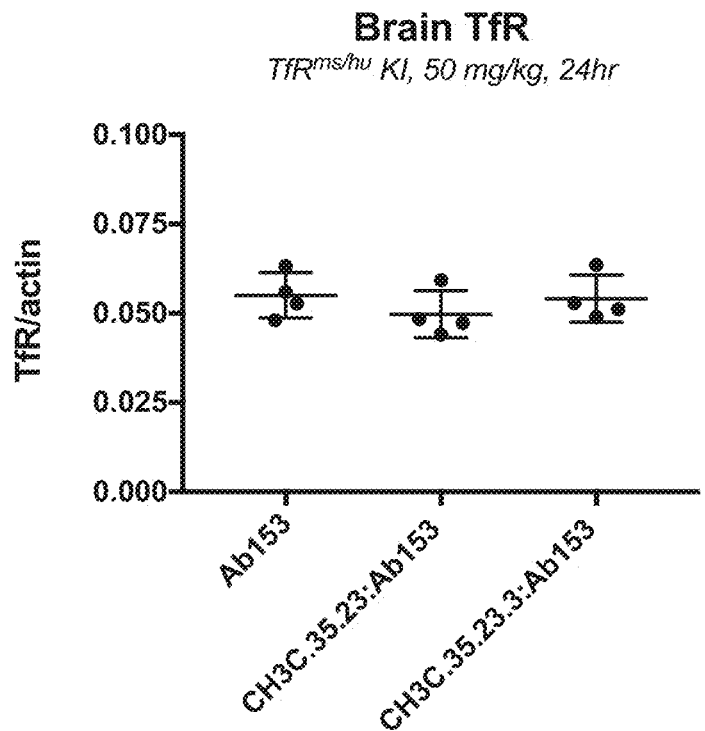
FIG. 45D depicts Western blot quantification of brain TfR protein normalized to actin in brain lysate of hTfR$^{apical+/+}$ KI mice after a single 50 mg/kg systemic injection of anti-BACE1_Ab153, CH3C.35.23:Ab153, or CH3C.35.23.3: Ab153 polypeptide fusion (mean±SEM, n=4 per group).

To further evaluate the relationship between PK and brain uptake with a wider affinity range of TfR-binding polypeptide-Fab fusions, additional fusions with a wider affinity range for hTfR binding was generated. The binding affinities of CH3C.35.23:Ab153 and CH3C.35.23.3:Ab153 fusions to human TfR are 420 nM and 1440 nM, respectively. hTfRapical$^{+/+}$ knock-in mice were dosed as described above. Plasma PK and brain PKPD were evaluated at 1, 4, 7, and 10 days post-dose. Peripheral PK of the polypeptide-Fab fusions were hTfR affinity-dependent, where the higher affinity CH3C.35.23:Ab153 fusion exhibited faster clearance compared to the much lower affinity CH3C.35.23.3:Ab153 fusion (FIG. 45A). Both CH3C.35.23:Ab153 and CH3C.35.23.3:Ab153 fusions had significantly greater brain exposure than compared to Ab153 alone, with CH3C.35.23:Ab153 achieving about 36 nM in brain at 1 day post-dose (FIG. 45B). Despite similar plasma concentrations, this maximum brain uptake of CH3C.35.23.3:Ab153 fusion was lower than that of CH3.35.23:Ab153 fusion, likely due to the about 3.5-fold lower affinity of the latter fusion for hTfR. Interestingly, because the lower affinity fusion provided a more sustained peripheral exposure by day 10, its brain exposure was also higher than that of the higher affinity CH3C.35.23:Ab153 fusion. This illustrates a trade-off of lower brain $C_{max}$ but more sustained PK over time for lower affinity TfR-binding polypeptide-Fab Fusions. Significantly lower concentrations of Aβ40 was observed in brains of mice dosed with the anti-BACE1 polypeptide fusions compared to anti-BACE1 alone (FIG. 45C). This duration of Aβ40 reduction was consistent with levels of huIgG1 exposure in brain over time (FIG. 45B). Impressively, mice dosed with CH3C.35:Ab153 fusion exhibited a prolonged brain Aβ40 reduction out to 7-10 days after a single dose. Total brain TfR levels were comparable between mice dosed with Ab153 versus CH3C.35:Ab153 fusion at 1 day post-dose (FIG. 45D). Together these data demonstrate that TfR-binding polypeptide fusion can increase brain exposure of anti-BACE1 to significantly reduce brain Aβ40 after a single dose.

Example 6

CH3C.18 Fc and Transferrin Receptor Apical Domain Crystallization

This example describes the crystallization and analysis of the binding interface between CH3C.18 and the apical domain of the transferrin receptor (TfR-AD).

Expression

The apical domain of human transferrin receptor (TfR-AD) and an engineered human Fc (CH3C.18 Fc) were expressed (SEQ ID NOS:301 and 302, respectively) in Expi293 cells at the initial cell density of 2.5×10⁶ cells/mL. Expressions were performed in volumes of 200 mL or more, as necessary. Kifunensine, a glycosylation inhibitor, was added 20 hours post transfection at a final concentration of 25 µM. Expression cultures were collected 3 to 4 days post transfection, when cell viability had significantly decreased.

Purification

Expressed TfR-AD and CH3C.18 Fc were purified with protein A and Ni-NTA resins, respectively, followed by size-exclusion chromatography on a Superdex200 26/60 gel filtration column. The following buffers were used:
Protein A wash buffer: 20 mM Hepes pH 7.4, 100 mM NaCl;
Protein A elution buffer: 30 mM glycine pH 2.5 (the eluate was collected into a tube containing 1M Tris, pH 9.0 to immediately neutralize the eluate);
Ni-NTA wash buffer: 30 mM Tris pH, 10 mM imidazole, and 200 mM NaCl;
Ni-NTA elution buffer: 30 mM Tris pH 8.0, 200 mM NaCl, and 250 mM imidazole; and
Size-exclusion buffer (SEC): 30 mM HEPES pH 7.5, 200 mM NaCl, and 3% glycerol.

Complex Formation and Purification

Figure 34:
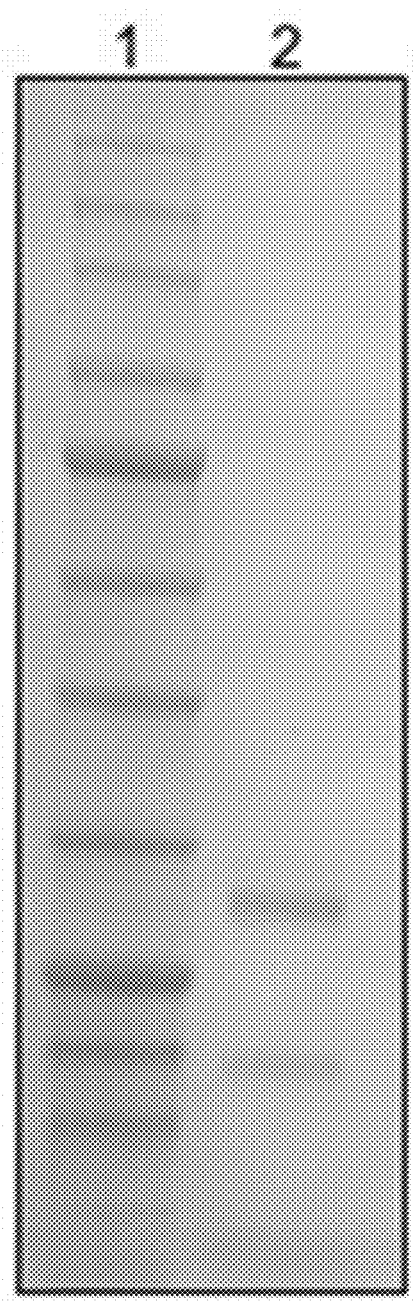
FIG. 34 shows an SDS-PAGE gel of the sizing fraction of the CH3C.18 Fc and the TfR apical domain (AD) complex. Lane 1: Molecular weight marker. Lane 2: Reduced CH3C.18 Fc-AD complex after size-exclusion chromatography.
Figure 35A:
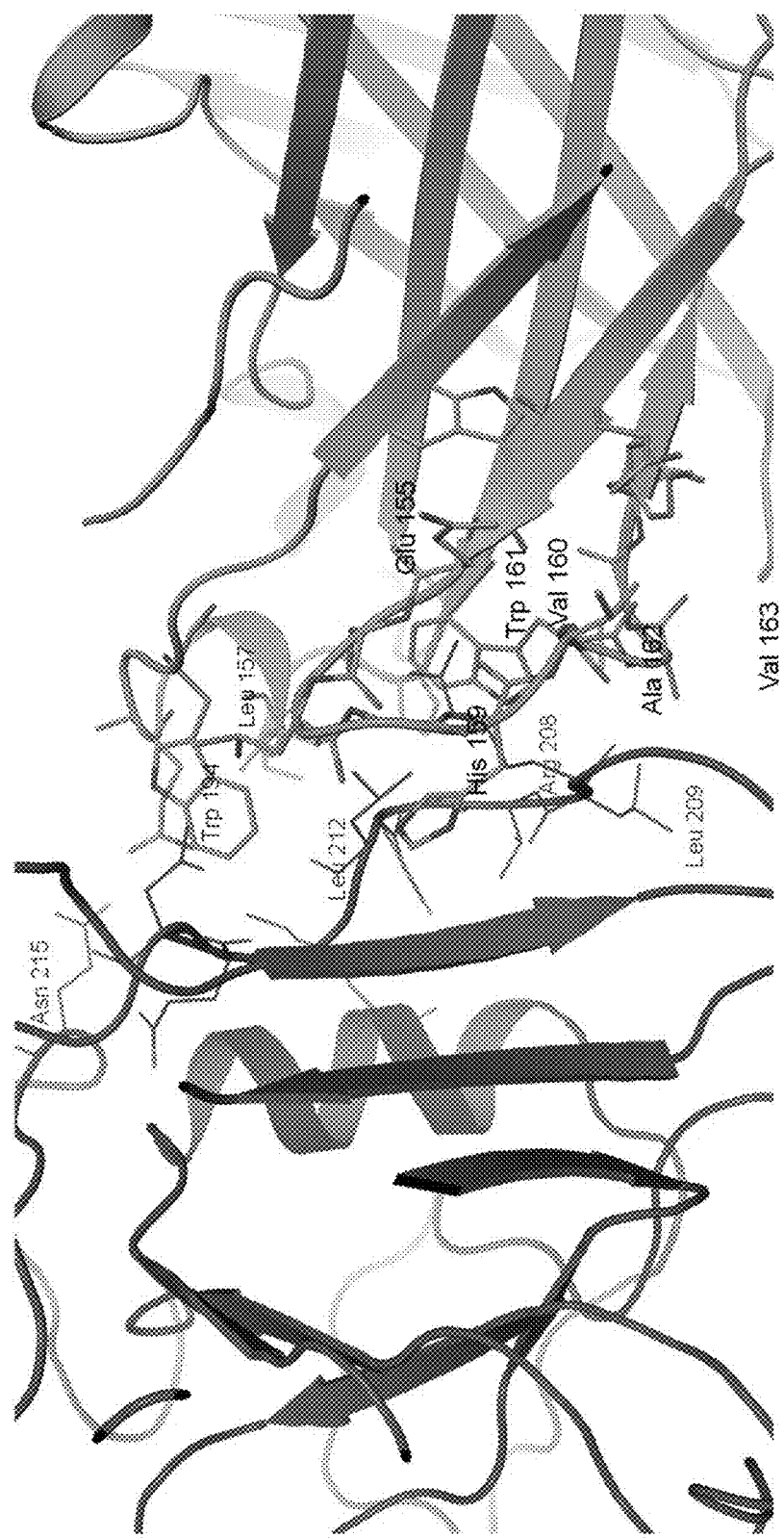
FIGS. 35A and 35B depict binding between polypeptides of the present invention and the transferrin receptor.
Figure 35B:
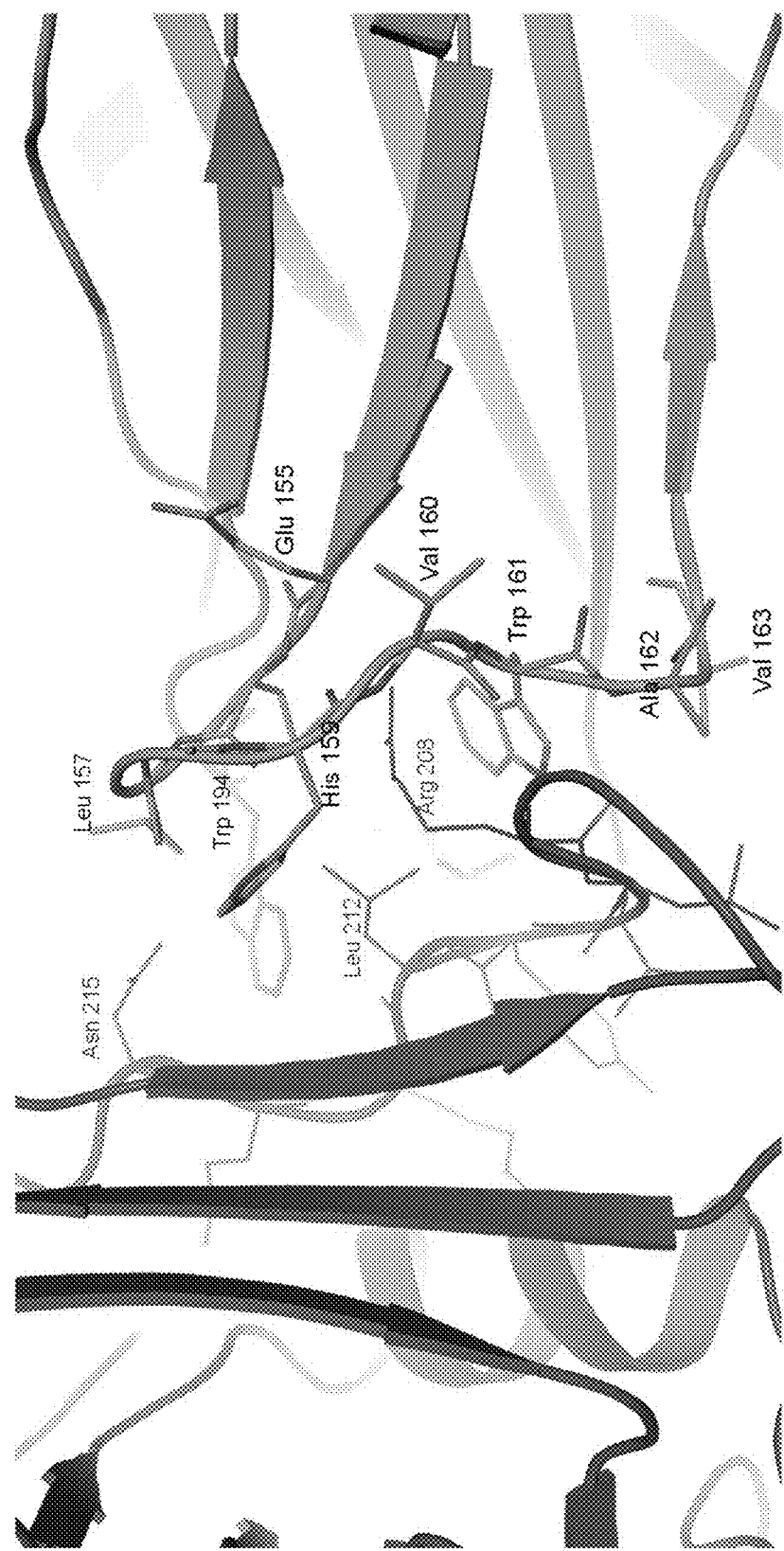
Figure 36A:
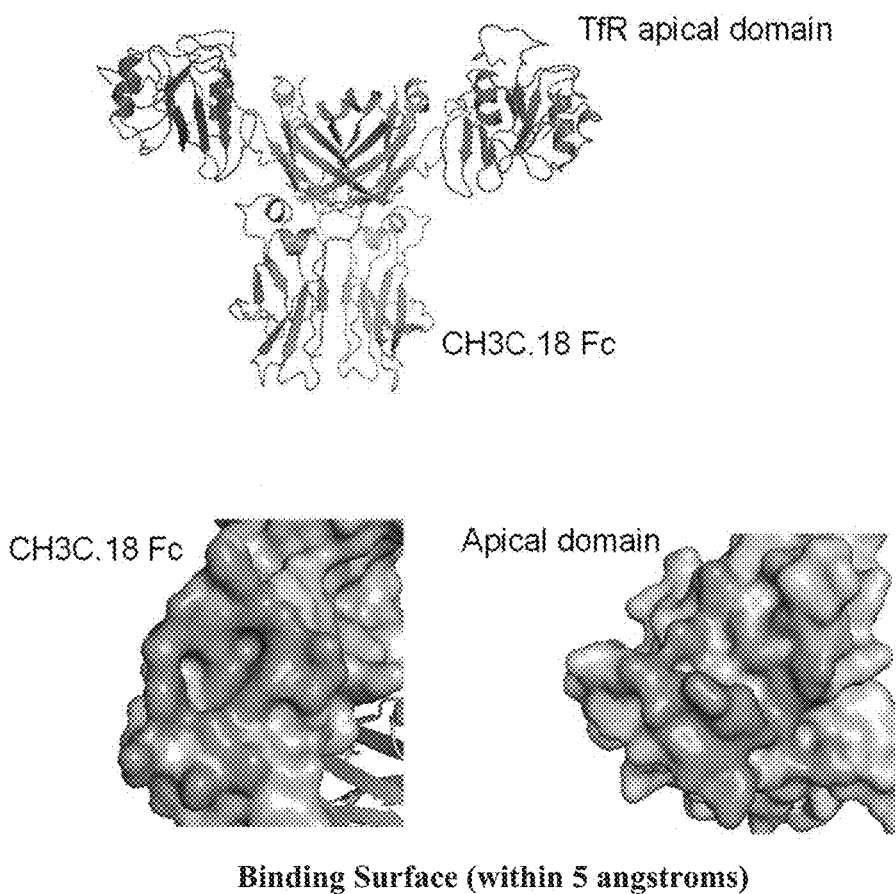
FIGS. 36A and 36B depict interactions between CH3C.18 and the TfR apical domain.
Figure 36B:
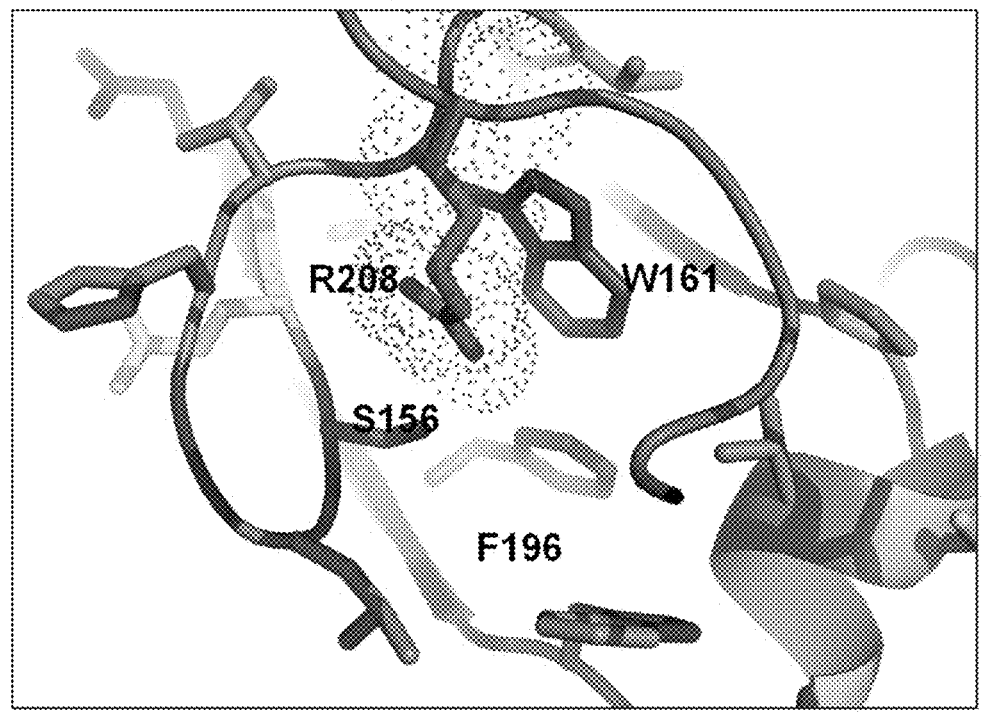

Purified TfR-AD and CH3C.18 Fc were mixed with an excess of apical domain, incubated at room temperature for 1 hour, and the complex was purified using size-exclusion chromatography on a Superdex200 26/60 gel-filtration column using the previously mentioned SEC buffer. The sizing gave two major peaks as expected; one corresponded to the complex (retention volume=180 ml) and the other one corresponded to the excess apical domain (retention volume=240 ml). The peak fractions were analyzed by Coomassie stained SDS-PAGE gel (FIG. 34).

Crystallization

Initial crystallization screening of the complex was performed by the sitting drop vapor diffusion method at 15° C. and room temperature (RT) at 8.5 mg/mL protein concentration. Showers of thin needles of crystals were observed in the condition that contained 25% PEG 3350, 0.1M Tris pH 8.5 and 0.2M MgCl₂. These crystals were used to seed in the same condition but at 20% PEG 3350 to produce single thin needles of mountable size.

X-Ray Data Collection

Crystals were flash-cooled by direct immersion in liquid nitrogen using the crystallization mother liquor supplemented with 20% (v/v) ethylene glycol. X-ray intensity data were collected at the SER-CAT beam line of the Advanced Photon Source (APS) using a Rayonix 300 high speed detector. Crystals were diffracted to 3.6 Å, and belonged to the hexagonal space group P6₄ with two complex molecules in the asymmetric unit (Table 17). Data were indexed, integrated, and scaled using the program HKL2000. Data collected from two crystals were merged to produce 3.6 Å data.

TABLE 17

Crystal data for CH3C.18 Fc-TfR-AD complex structure

| Name/code | | CH3C.18 Fc-TfR-AD complex |
|---|---|---|
| Cell dimensions | a (Å) | 124.3 |
| | b | 124.3 |
| | c | 113.1 |
| | α (°) | 90.0 |
| | β | 90.0 |
| | γ | 120.0 |
| Space group | | P6₄ |
| Resolution range (Å) | Overall | 50-3.6 |
| | Last shell | 3.71-3.6 |
| Number of unique reflections | | 11,259 |
| Completeness (%) | (Overall/Last shell) | 95.9/74.1 |
| $R_{merge}$[1] | (Overall/Last shell) | 20/93 |
| Refinement Statistics | Resolution (Å) | 50-3.6 |
| | R factor[2]/Rfree (%) | 30/39 |

[1] $R_{merge} = \Sigma_j(|I_h - <I>_h|)/\Sigma I_h$, where $<I_h>$ is the average intensity over symmetry equivalents
[2] R-factor = $\Sigma |F_{obs} - F_{calc}|/\Sigma |F_{obs}|$ Structure Determination and Refinement The crystal structure of the complex was determined by molecular replacement with PHASER using the CH3C.18 Fc dimer and TFR-AD monomer as the initial search models. The model was refined by rigid-body refinement followed by restrained refinement using REFMAC. All crystallographic calculations were performed with the CCP4 suite of programs (www.ccp4.ac.uk/). Model building of the complex into the electron density was done using the graphics program COOT. The electron density for the complex molecule was good, especially at the CH3C.18 Fc-TfR-AD interface (2Fo-Fc map contoured to 1.2 sigma level). After iterative model building and refinement, high R and freeR (R/freeR=0.30/0.39) were noticed due to the low resolution of the data and disordered CH2 domain. The disorder of the CH2, as found in other available Fc structures, was due to the flexible elbow angle between the CH2 and CH3 domains.

Binding Interface Interactions

Figure 37A:
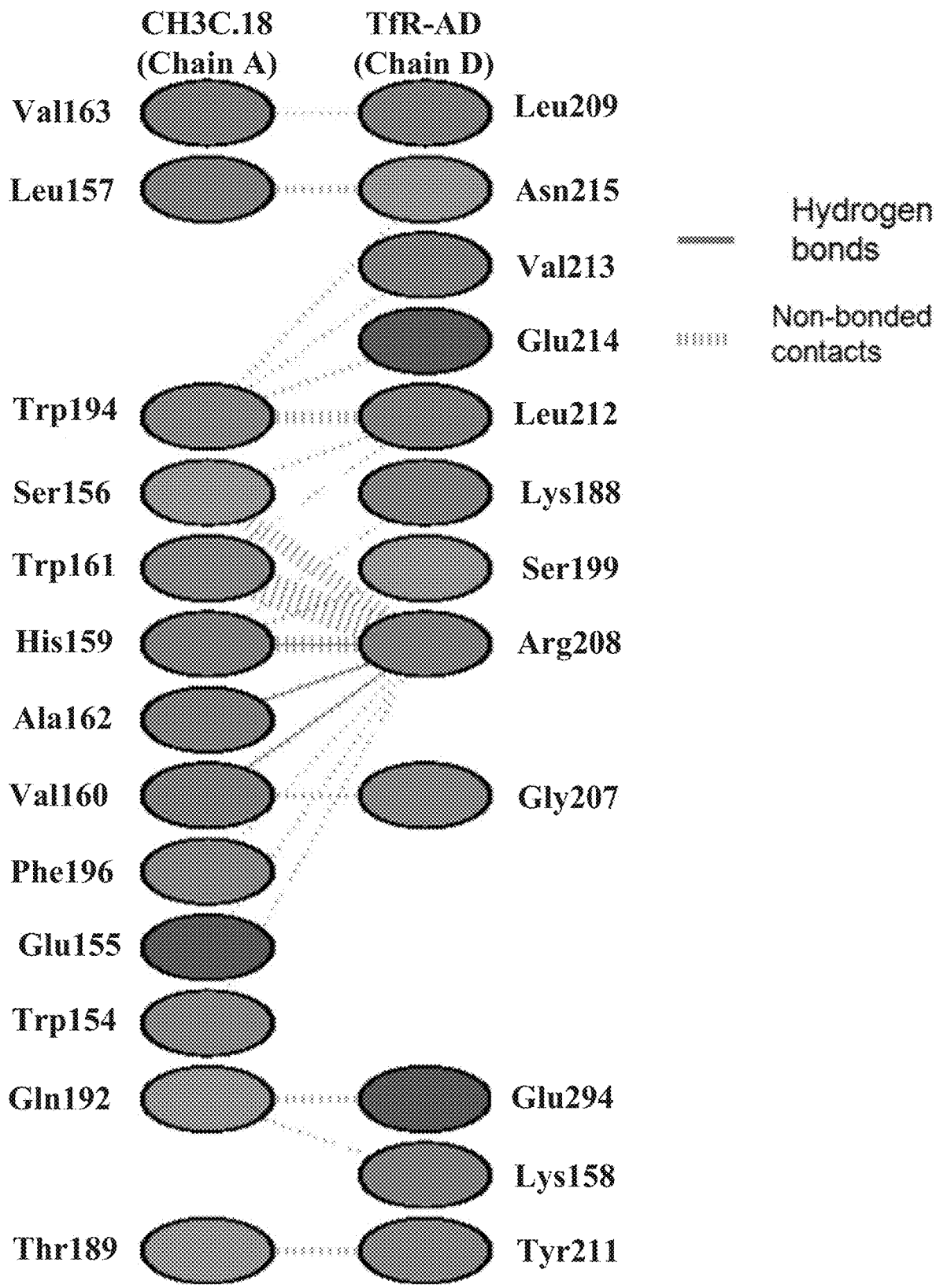
FIGS. 37A and 37B depict binding between polypeptides of the present invention and the transferrin receptor.
Figure 37B:
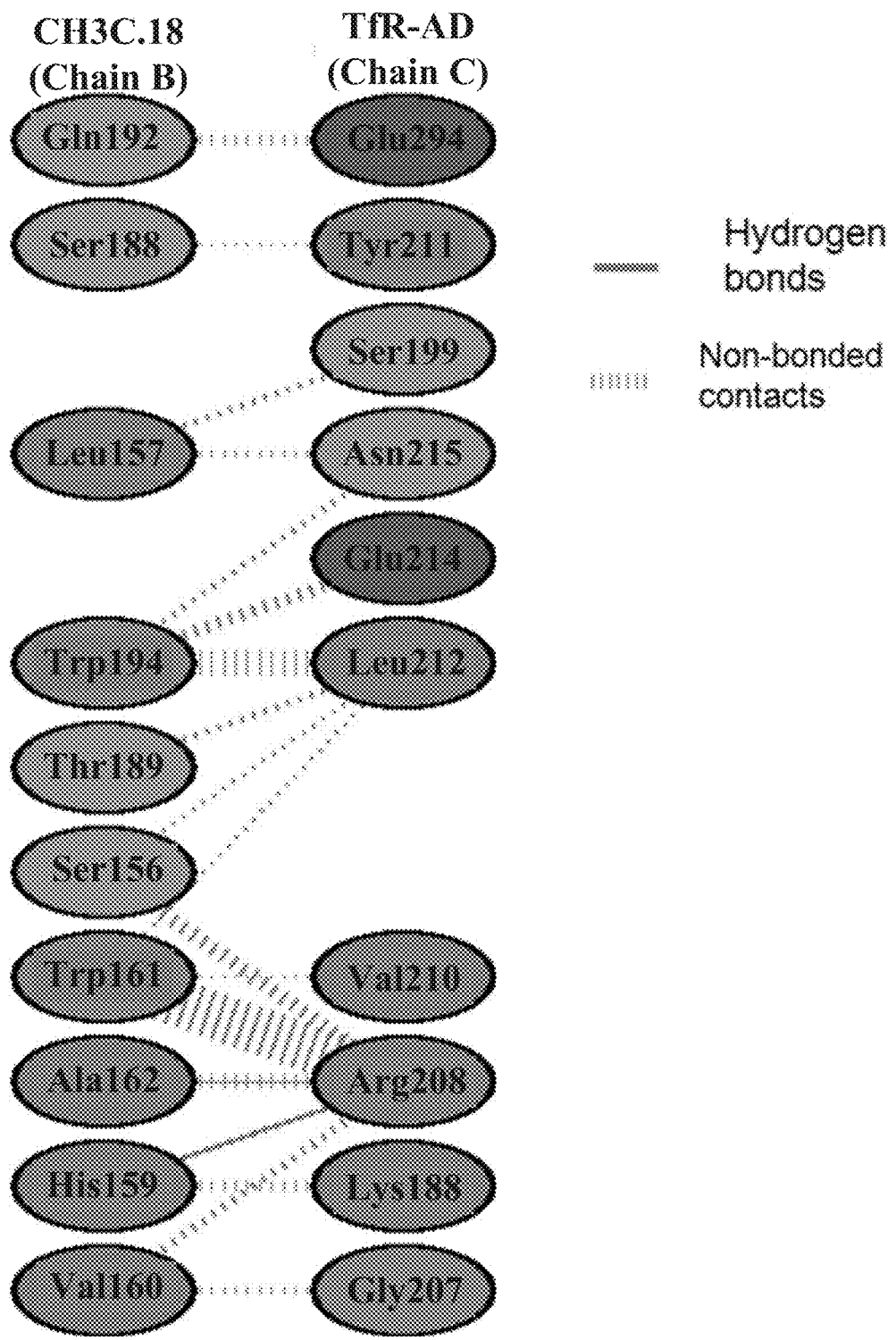

The binding interface between CH3C.18 Fc and TfR-AD is depicted in FIGS. 35A-35B and FIGS. 36A-36B. As shown in FIGS. 37A-37B, interactions were observed between:

Trp154 of CH3C.18 and Arg208 of TfR-AD;
Glu155 of CH3C.18 and Arg208 of TfR-AD;
Ser156 of CH3C.18 and Arg208 and Leu212 of TfR-AD;
Leu157 of CH3C.18 and Ser 199 and Asn215 of TfR-AD;
His159 of CH3C.18 and Lys188, Ser199, and Arg208 of TfR-AD;
Val160 of CH3C.18 and Gly207 and Arg208 of TfR-AD;
Trp161 of CH3C.18 and Arg208, Val210, and Leu212 of TfR-AD;
Ala162 of CH3C.18 and Arg208 of TfR-AD;
Val163 of CH3C.18 and Leu209 of TfR-AD;
Ser188 of CH3C.18 and Tyr211 of TfR-AD;
Thr189 of CH3C.18 and Tyr211 and Leu212 of TfR-AD;
Gln192 of CH3C.18 and Lys158 and Glu294 of TfR-AD;
Trp194 of CH3C.18 and Leu212, Val213, Glu214, and Asn215 of TfR-AD; and
Phe196 of CH3C.18 and Arg208 of TfR-AD.

Furthermore, as described in the section titled "Paratope Mapping" of Example 2 and as shown in FIGS. 37A-37B, several positions outside of the CH3C register also participate in binding to TfR.

Example 7

CH3C.35 Fc and Transferrin Receptor Apical Domain Crystallization

This example describes the crystallization and analysis of the binding interface between CH3C.35 and the apical domain of the transferrin receptor (TfR-AD).

Expression

The apical domain of human transferrin receptor (TfR-AD) and an engineered human Fc (CH3C.35 Fc) were expressed (SEQ ID NOS:301 and 421, respectively) in CHO cells at an initial cell density of $2.5 \times 10^6$ cells/mL. Expressions were performed in volumes of 500 mL or more, as necessary. Expression cultures were collected 3 to 4 days post transfection, when cell viability had significantly decreased.

Purification

Expressed TfR-AD and CH3C.35 Fc were purified with protein A (Genescript) and Ni-NTA (Sigma) resins, respectively, followed by size-exclusion chromatography on a Superdex200 26/60 gel filtration column. The following buffers were used:

Protein A elution buffer: 30 mM glycine pH 2.5 (the eluate was collected into a tube containing 1 M Tris, pH 9.0 to immediately neutralize the eluate);

Ni-NTA elution buffer: 30 mM Tris pH 8.0, 200 mM NaCl, and 250 mM imidazole; and Size-exclusion buffer (SEC): 30 mM HEPES pH 7.5, 150 mM NaCl, 50 mM KCl, 3% glycerol, and 0.01% sodium azide.

Complex Formation and Purification

Purified TfR-AD and CH3C.35 Fc were mixed with an excess of apical domain, incubated at room temperature for 1 hour, and the complex was purified using size-exclusion chromatography on a Superdex200 26/60 gel filtration column using the previously mentioned SEC buffer.

Crystallization

Initial crystallization screening of the complex was performed by the sitting drop vapor diffusion method at 4° C., 15° C., and room temperature (RT). Showers of thin needles of crystals were observed in the condition that contained 25% PEG 3350, 0.1 M Bis-Tris pH 6.5, and 0.2 M LiSO$_4$. These crystals were used to seed in the same condition but at 20% PEG 3350 to produce single thin needles and the seeding was repeated sequentially four times to produce crystals of mountable size.

X-Ray Data Collection

Crystals were flash-cooled by direct immersion in liquid nitrogen using the crystallization mother liquor supplemented with 20% (v/v) ethylene glycol. X-ray intensity data were collected at 104 beam line of the Diamond Light Source (DLS) using PILATUS detector. Micro focus beam of size 5 micron was used for the data collection. Crystals were diffracted to 3.38 Å, and belonged to the hexagonal space group P6$_4$ with two complex molecules in the asymmetric unit (Table 18). Data were indexed, integrated, and scaled using the CCP4 suite programs (Xia2-XDS and XSCALE).

TABLE 18

Crystal data for CH3C.35 Fc-TfR-AD complex structure

| Name/code | | CH3C.35 Fc-TfR-AD complex |
|---|---|---|
| Cell dimensions | a (Å) | 126.4 |
| | b | 126.4 |
| | c | 113.8 |
| | α (°) | 90.0 |
| | β | 90.0 |
| | γ | 120.0 |
| Space group | | P6$_4$ |
| Resolution range (Å) | Overall | 50-3.38 |
| | Last shell | 3.44-3.38 |
| Number of unique reflections | | 14,541 |
| Completeness (%) | (Overall/Last shell) | 100/99.7 |
| R$_{merge}$[1] | (Overall/Last shell) | 31/152 |
| Refinement Statistics | Resolution (Å) | 50-3.38 |
| | R factor[2]/Rfree (%) | 27/35 |

[1]$R_{merge} = \Sigma_j(| I_h - <I>_h|)/\Sigma I_h$, where $<I_h>$ is the average intensity over symmetry equivalents
[2]R-factor = $\Sigma | F_{obs} - F_{calc} |/\Sigma | F_{obs} |$

Structure Determination and Refinement

The crystal structure of the complex was determined by molecular replacement with PHASER using the CH3C.35 Fc-AD TfR complex as the search model. The model was refined by rigid-body refinement followed by restrained refinement using REFMAC. All crystallographic calculations were performed with the CCP4 suite of programs. Model building of the complex into the electron density was done using the graphics program COOT. The electron density for the complex molecule was good, especially at the CH3C.35 Fc-TfF-AD interface.

Binding Interface Interactions

Figure 39A:
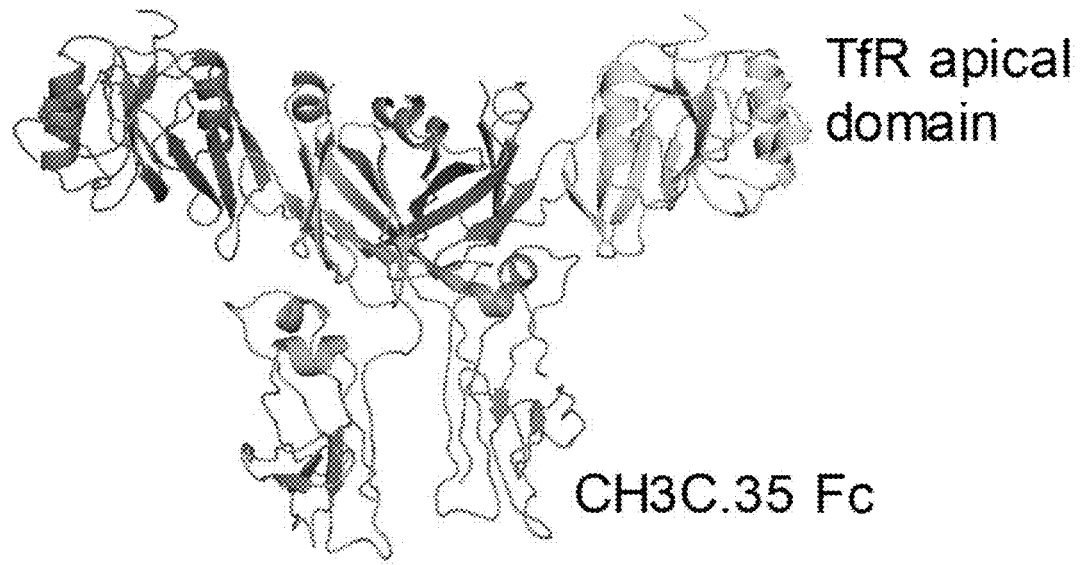
FIGS. 39A-39C depict binding between polypeptides of the present invention and the transferrin receptor.
Figure 39B:
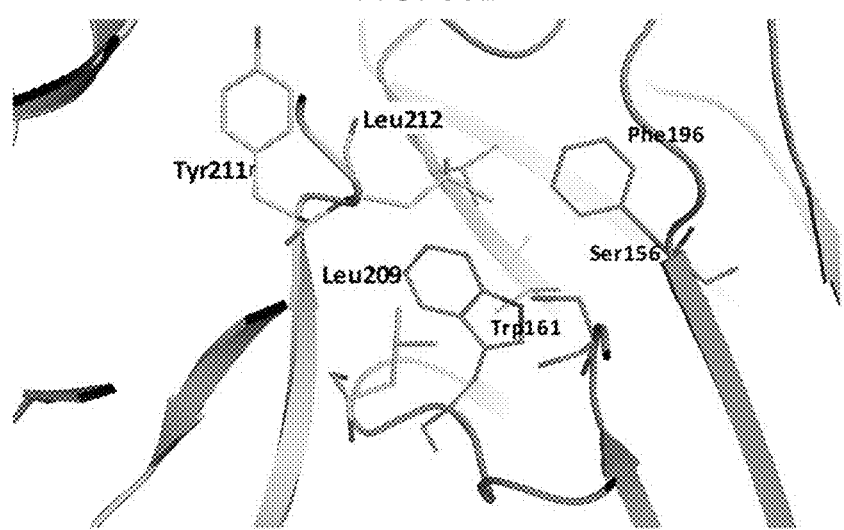
Figure 39C:
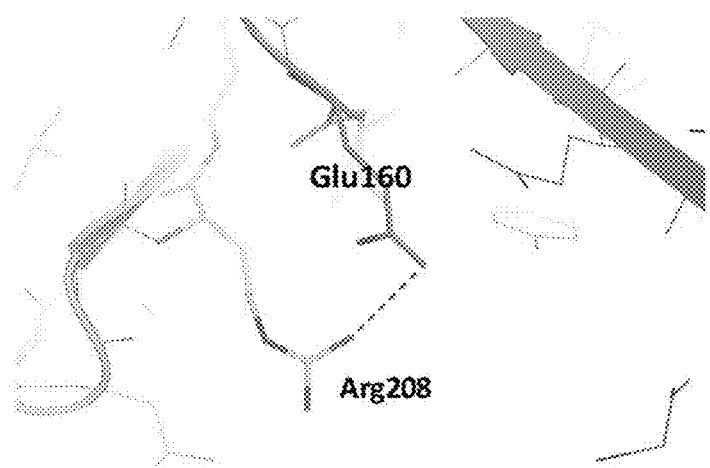
Figure 40A:
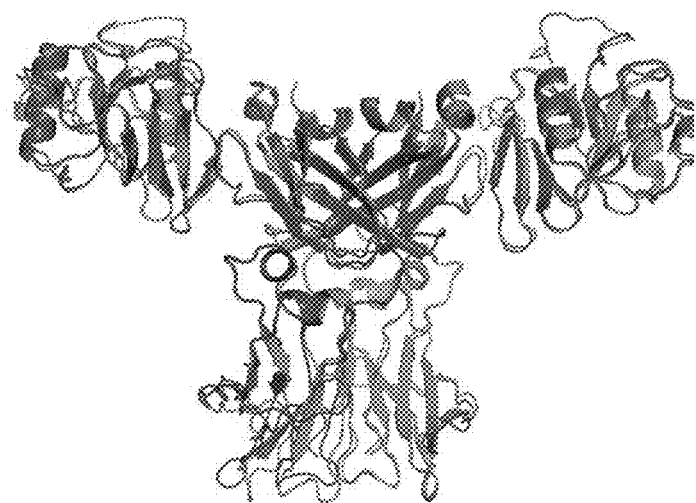
FIG. 40A depicts an overlaid structure between the CH3C.35 Fc and TfR-AD complex and the CH3C.18 Fc and TfR-AD complex.
Figure 40B:
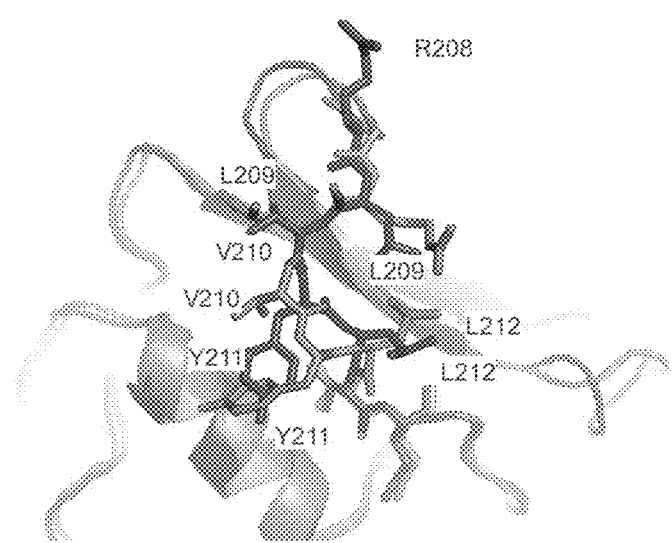
FIG. 40B depicts an enlarged view of the overlaid structure in FIG. 40A.

The binding interface between CH3C.35 Fc and TfR-AD is depicted in FIGS. 39A-39C. FIG. 39A shows the complex of CH3C.35 Fc and TfR-AD at 3.4 Å. FIG. 39B shows residue W161 in CH3C.35 Fc is stabilized by residues L209, L212, and Y211 in TfR-AD. FIG. 39C shows a salt bridge between residue E160 in CH3C.35 Fc and residue R208 in TfR-AD as a central binding interaction, which may partially account for the difference in binding affinity of the Fc polypeptide to human TfR (Arg at position 208) and to cynomolgus TfR (Gly at position 208). FIG. 40A shows an overlaid structure between the CH3C.35 Fc and TfR-AD complex and the CH3C.18 Fc and TfR-AD complex (described in Example 6), demonstrating that there is no significant Fc backbone conformational change between CH3C.35 and CH3C.18. FIG. 40B shows an enlarged view of the overlaid structure in FIG. 40A. Residues 206-212 in TfR-AD of the CH3C.35 Fc/TfR-AD complex adopted different conformations from the residues in the TfR-AD of the CH3C.18 Fc/TfR-AD complex. Residue R208 in TfR-AD appeared buried in surface of the CH3C.18 Fc/TfR-AD complex, but appeared solvent exposed in the CH3C.35 Fc/TfR-AD complex. Further, residue L209 in TfR-AD of the CH3C.35 Fc/TfR-AD complex appeared rotated 180° and bound to the surface, but appeared away from the surface in the in the CH3C.18 Fc/TfR-AD complex.

Figure 41A:
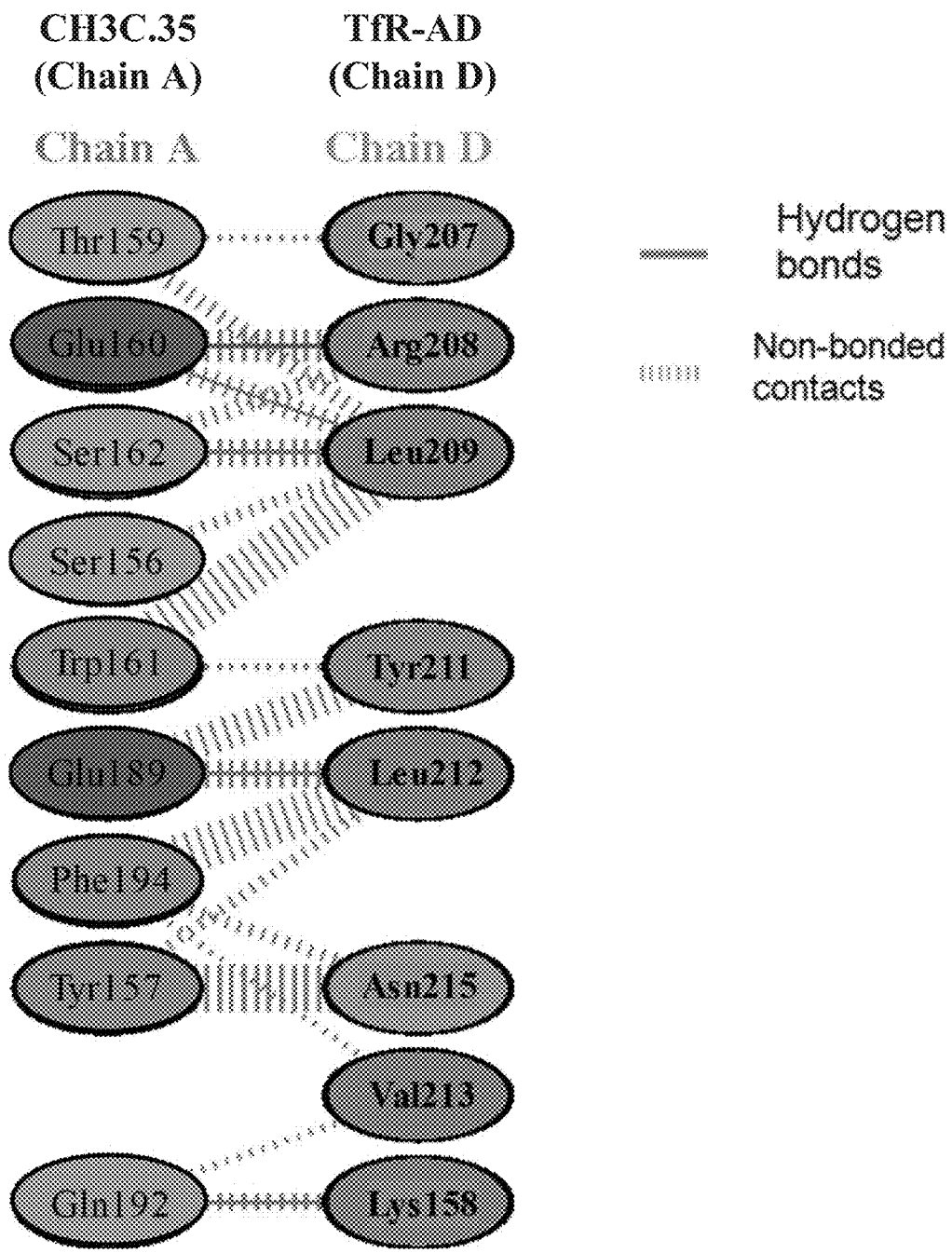
FIGS. 41A and 41B depict binding between polypeptides of the present invention and the transferrin receptor.
Figure 41B:
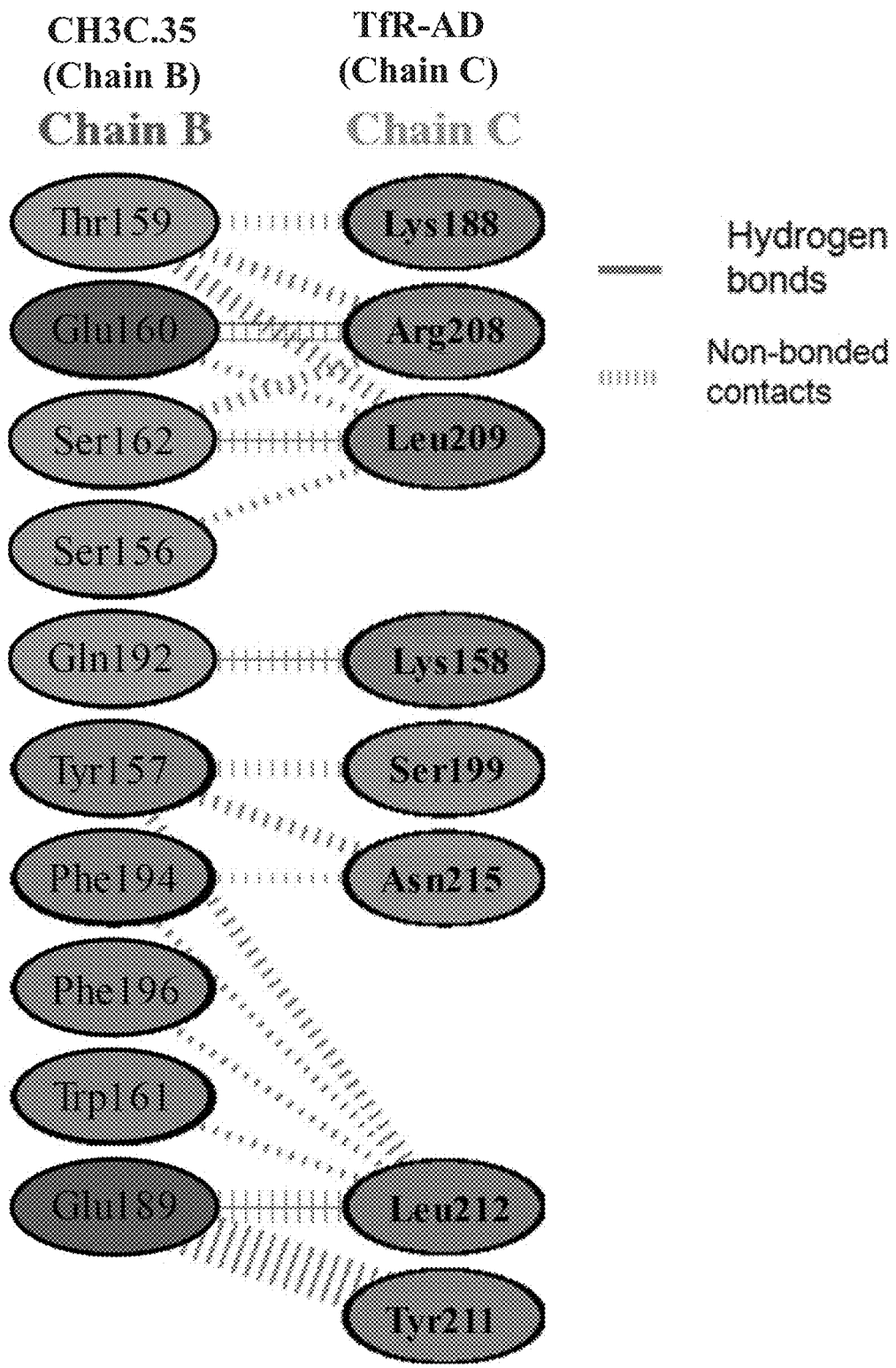

As shown in FIGS. 41A and 41B, interactions were observed between:

Thr159 of CH3C.35 and Gly207, Arg208, Lys188, and Leu209 of TfR-AD;

Glu160 of CH3C.35 and Arg208 and Leu209 of TfR-AD;

Ser162 of CH3C.35 and Arg208 and Leu209 of TfR-AD;

Ser156 of CH3C.35 and Leu209 of TfR-AD;

Trp161 of CH3C.35 and Leu209, Tyr211, and Leu212 of TfR-AD;
Glu189 of CH3C.35 and Tyr211 and Leu212 of TfR-AD;
Phe194 of CH3C.35 and Leu212, Asn215, and Val213 of TfR-AD;
Tyr157 of CH3C.35 and Leu212, Asn215, and Ser199 of TfR-AD;
Gln192 of CH3C.35 and Val213 and Lys158 of TfR-AD; and
Phe196 of CH3C.35 and Val213 and Leu212 of TfR-AD.

bivalent Fc-Fab fusion polypeptide comprising clone CH3C.35.21 fused to the Ab153 Fab domain. "CH3C.35.8:Ab153" is a bivalent Fc-Fab fusion polypeptide comprising clone CH3C.35.20 fused to the Ab153 Fab domain. "LALAPG" indicates that the antibody or Fc-Fab fusion polypeptide contains the mutations L7A, L8A, and P102G in the Fc sequence (as numbered with reference to SEQ ID NO:1). "LALAPG.YTE" indicates that the Fc-Fab fusion polypeptide contains the mutations L7A, L8A, P102G, M25Y, S27T, and T29E in the Fc sequence (as numbered with reference to SEQ ID NO:1).

TABLE 19

| Treatment | Isotype | Cyno TfR full-length affinity (nM) | Cyno TfR apical affinity (nM) | Dose | N | Material (mg) |
|---|---|---|---|---|---|---|
| Ab122 (control IgG) | huIgG1.LALAPG | — | | 30 | 4 | 750 |
| Ab153 | huIgG1.LALAPG | — | | 30 | 4 | 750 |
| Ab210 | huIgG1.LALAPG | 52 | 140 | 30 | 4 | 750 |
| CH3C.35.21.16:Ab153 (monovalent) | huIgG1.LALAPG | 1800 | 1900 | 30 | 4 | 750 |
| CH3C.35.21.16:Ab153 (monovalent) | huIgG1.LALAPG.YTE | 1800 | 1900 | 30 | 4 | 750 |
| CH3C.35.21:Ab153 (monovalent) | huIgG1.LALAPG.YTE | 2100 | 2200 | 30 | 4 | 750 |
| CH3C.35.9:Ab153 (bivalent) | huIgG1.LALAPG.YTE | 700 | | 30 | 4 | 750 |
| CH3C.35.8:Ab153 (bivalent) | huIgG1.LALAPG.YTE | 1700 | | 30 | 4 | 750 |

Furthermore, as described in the section titled "Paratope Mapping" of Example 2 and as shown in FIGS. 41A and 41B, several positions outside of the CH3C register also participate in binding to TfR.

Example 8

Pharmacokinetic/Pharmacodynamic Studies of Fc-Fab Fusion Polypeptides Comprising CH3C Variants in Cynomolgus Monkeys This example describes pharmacokinetic/pharmacodynamic (PK/PD) characterization of Fc-Fab fusions comprising CH3C variant polypeptides of the present invention in cynomolgus monkeys.

Study Design

A single 30 mg/kg dose of Ab122 (an anti-RSV antibody as control IgG), Ab153 (an anti-BACE1 antibody), Ab210 (anti-TfR/BACE1 bispecific antibody), or Fc-Fab fusion polypeptides comprising CH3C variant polypeptides fused to the Fab domain of Ab153 were intravenously administered in male cynomolgus monkeys 2-4 years old to evaluate plasma PK, plasma PD (Aβ40), and cerebrospinal fluid (CSF) PD (Aβ40) over the course of 29 days (n=4/group). To establish baseline, pre-dose CSF and blood samples were taken from each animal 7 days prior to dosing. After dosing, CSF was collected via an IT-L catheter at 12, 24, 48, 72, and 96 hours post-dose, and on study days 8, 11, 15, 18, 22, 25, and 29 for PD analysis. Blood samples were collected for plasma and serum PK at 0.25, 1, 6, 12, 24, 72 hours post-dose, and on study days 8, 11, 15, 18, 22, 25, and 29.

Table 19 shows an outline of the study design. "CH3C.35.21.16:Ab153" is a monovalent Fc-Fab fusion polypeptide comprising clone CH3C.35.21.16 fused to the Ab153 Fab domain. "CH3C.35.21:Ab153" is a monovalent Fc-Fab fusion polypeptide comprising clone CH3C.35.21 fused to the Ab153 Fab domain. "CH3C.35.9:Ab153" is a Methods Human IgG PK Assay Antibody or Fc-Fab fusion polypeptide concentrations in cyno serum were quantified using a human IgG-specific sandwich ELISA. A 384-well MaxiSorp plate was coated overnight with an antibody specific for the Fc of human IgG. Serum samples were diluted 1:100, 1:1,000, 1:10,000, and 1:100,000 and added to the blocked plates. The detection antibody was a polyclonal anti-human IgG monkey-absorbed antibody. The standard curves were prepared for each antibody or Fc-Fab fusion polypeptide individually (48-200,000 pg/mL IgG) and the assay has a lower limit of quantification (LLOQ) in serum of 20 ng/mL.

PD Assays

Soluble APPα/β levels in cyno CSF were measured using a MesoScale Discovery (MSD) multiplex kit (MSD #K15120E). Two different antibodies specifically captured either sAPPα or sAPPβ, and then both analytes were detected with a SULFO-tag labeled anti-APP mouse monoclonal antibody. Cyno Aβ40 levels were measured using a MSD ultra-sensitive kit (MSD #K151FTE). This assay used the huAβ-specific 6E10 antibody as the capture and an anti-Aβ40 antibody specific for the C-terminus of the peptide as the detection molecule. Both assays were run according to the manufacturer's instructions. Briefly, precoated plates were blocked for 1 hour with MSD Blocker A. CSF samples were diluted 1:5 and added in duplicate to the blocked plates followed by an overnight incubation at 4° C. Next, the respective detection antibodies were added and the plates read on a Sector S600 instrument. The standard curves, 0.92-3750 pg/mL huAβ40 and 0.1-100 ng/mL for both sAPPα/β, were fit using a four-parameter logistic regression. The assays had a LLOQ of 73 pg/mL for Aβ40 and 0.5 ng/mL for sAPPα/β.

Results

Figure 42A:
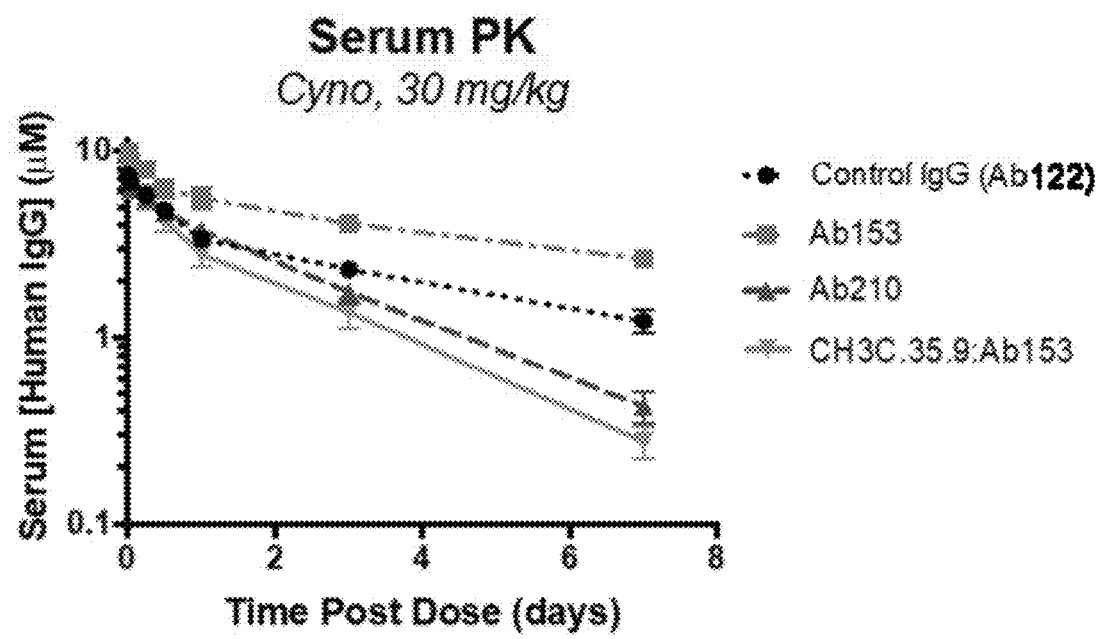
FIGS. 42A and 42B depict plasma PK and Aβ40 reduction for an Fc-Fab fusion polypeptide comprising a CH3C variant fused to the Ab153 Fab domain in cynomolgus monkeys.
Figure 42B:
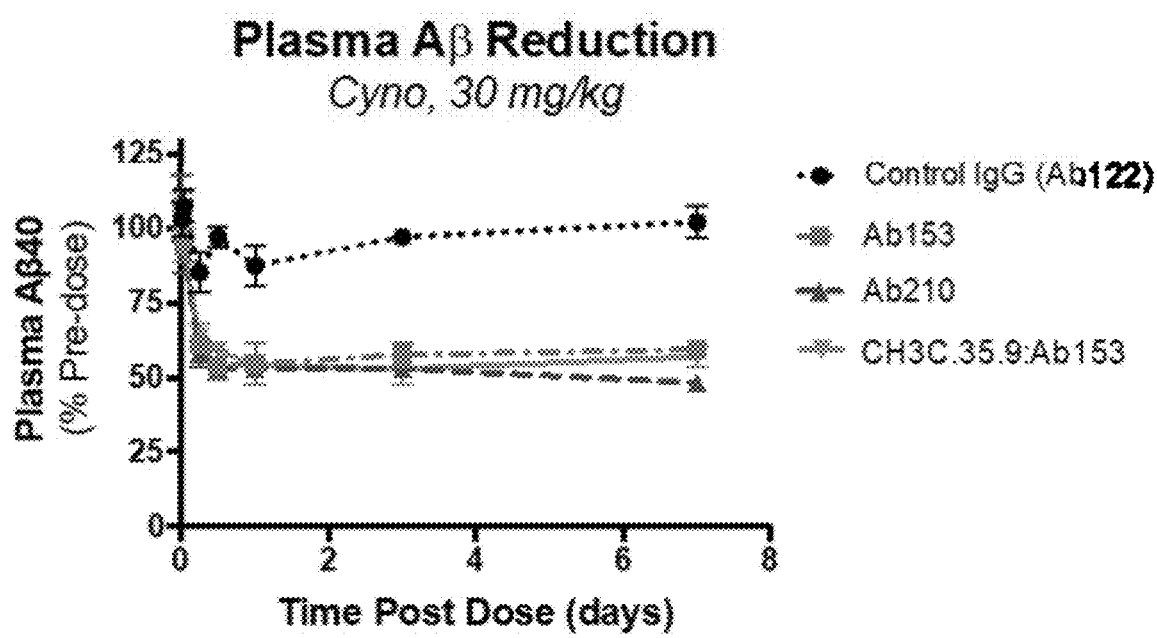
Figure 43A:
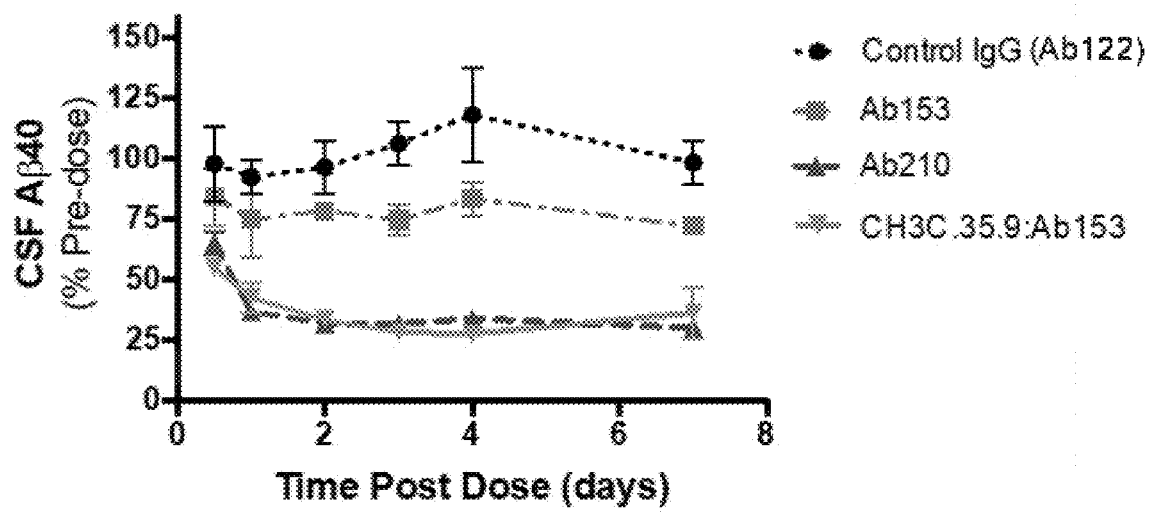
FIGS. 43A and 43B depict significant cerebrospinal fluid (CSF) Aβ and sAPPβ/sAPPα reduction with an Fc-Fab fusion polypeptide comprising a CH3C variant fused to the Ab153 Fab domain in cynomolgus monkeys.
Figure 43B:
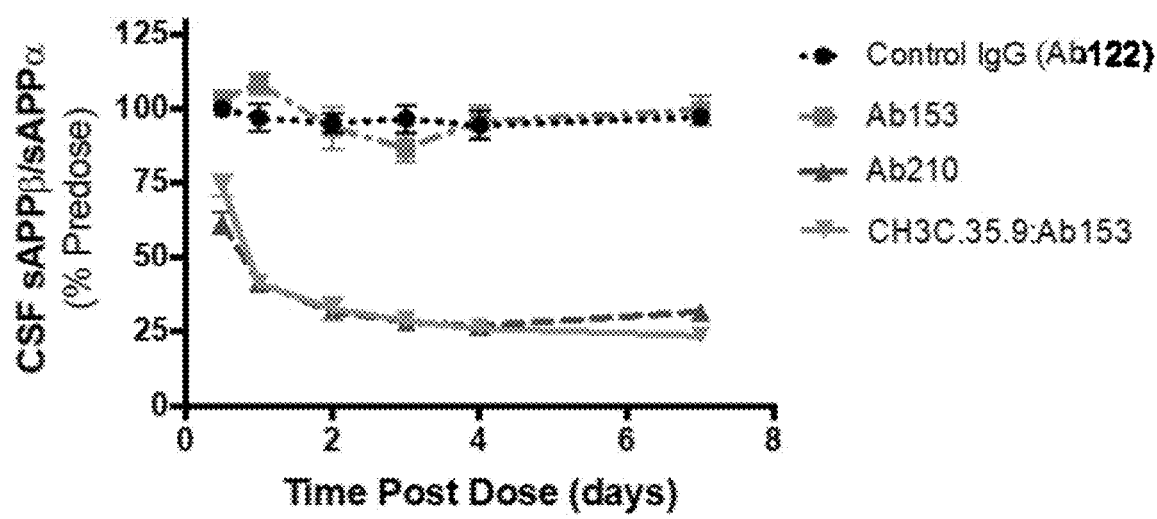

Interim serum PK from the first 7 days post-dose showed the expected target-mediated clearance for Ab210 and CH3C.35.9:Ab153 due to their binding to TfR in the periphery (FIG. 42A). Both Ab153 and Ab210 antibodies, as well as CH3C.35.9:Ab153, resulted in a significant and sustained reduction in plasma Aβ40 compared to control IgG (FIG. 42B), confirming all three molecules were able to inhibit BACE1 activity in vivo to a similar extent. In the CSF, both Ab210 and CH3C.35.9:Ab153 were able to reduce CSF Aβ40 and sAPPβ/sAPPα ratio to about 70% and about 75%, respectively, compared to control IgG (FIGS. 43A and 43B). Ab153, an anti-BACE1 antibody that does not bind TfR, showed minimal impact on CSF Aβ40 and sAPPβ/sAPPα ratio compared to control IgG. These results demonstrate that binding to TfR with a CH3C variant polypeptide (e.g., clone CH3C.35.9) enhances CNS penetration of an Fc-Fab fusion comprising the CH3C variant polypeptide fused to the Fab domain of an anti-BACE1 antibody (e.g., CH3C.35.9:Ab153) to inhibit CSF Aβ40 and sAPPβ/sAPPα production.

Figure 46A:
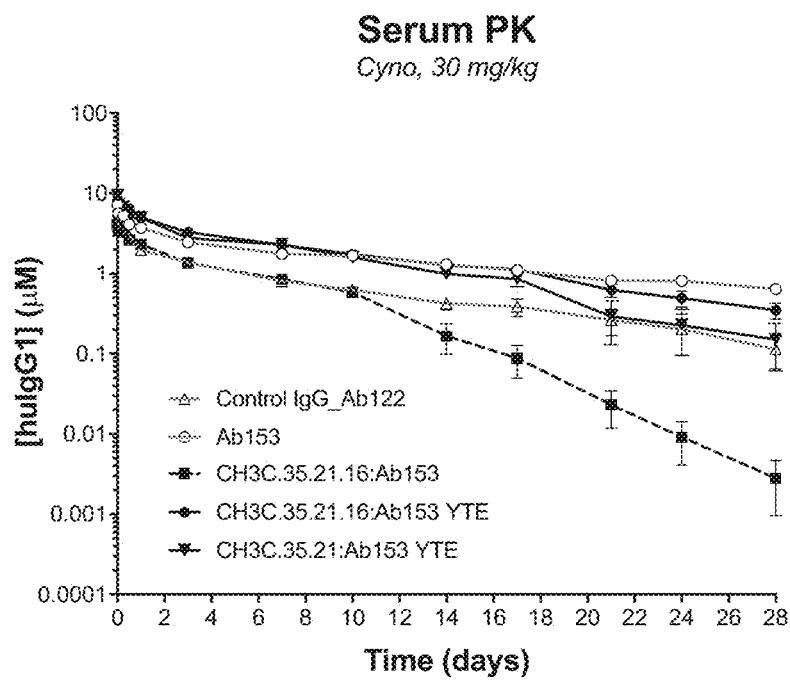
FIGS. 46A-46D depict 28-day PKPD study in cynomolgus monkeys after a single 30 mg/kg dose of the indicated proteins.
Figure 46B:
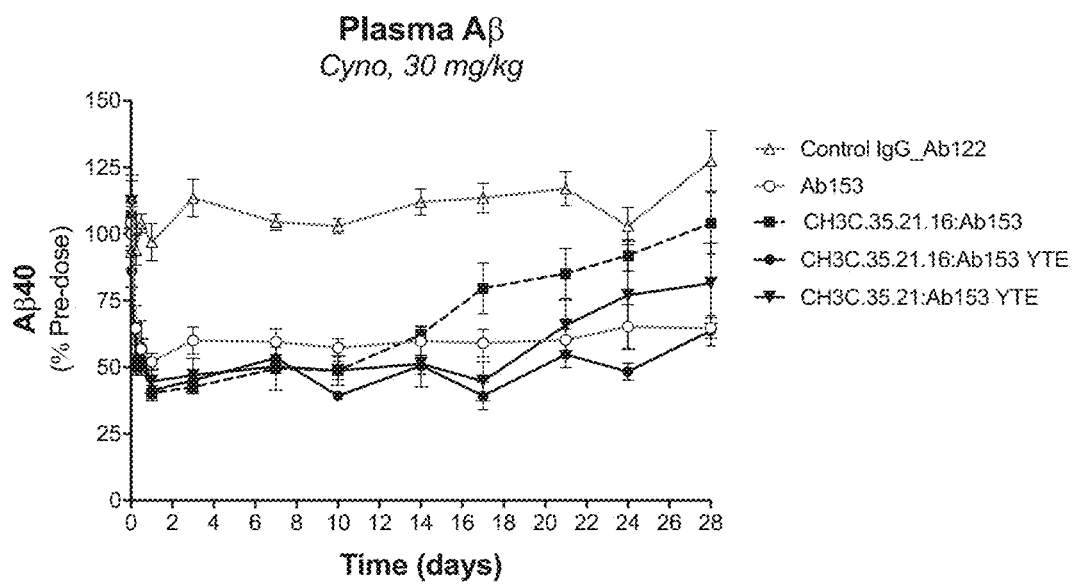
Figure 46C:
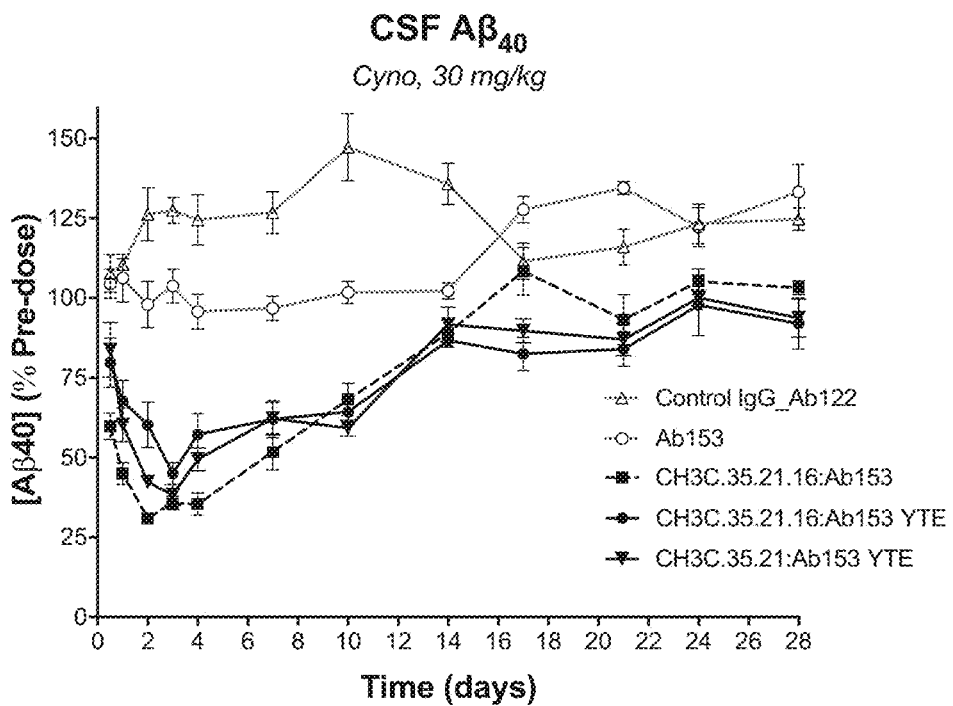
Figure 46D:
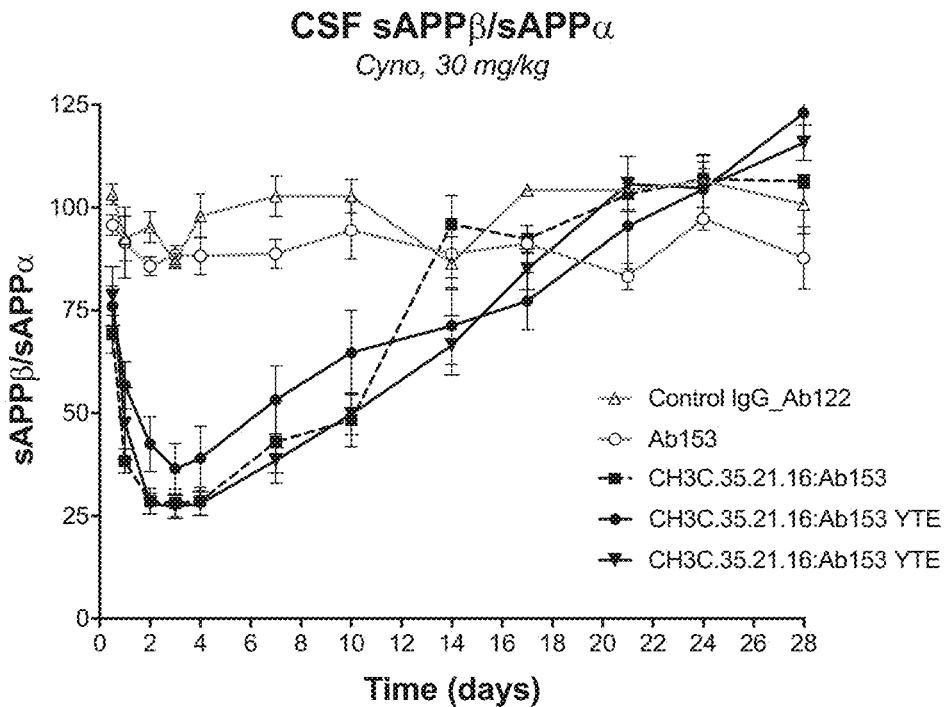

Serum PK, plasma Aβ, and CSF Aβ levels were also evaluated for four weeks following a single dose. Similar to what was observed in mouse, peripheral serum PK of TfR-binding Fc-Fab fusions (CH3C.35.21.16:Ab153 LALAPG, CH3C.35.21.16:Ab153 LALAPGYTE, and CH3C.35.21:Ab153 LALAPGYTE) exhibited faster clearance compared to Ab122 and Ab153 due to binding to TfR on peripheral tissues (FIG. 46A). Both Ab153 and CH3C: Ab153 fusion reduced plasma Aβ levels by greater than about 50% compared to control IgG_Ab122 (FIG. 46B). The maximum Aβ was similar between Ab153 and CH3C:Ab153 fusion, indicating that the Fc modifications did not affect ability of anti-BACE1 Fab to inhibit APP cleavage in vivo (FIG. 46B). The duration of plasma Aβ correlated with the exposure of Ab153 and CH3C:Ab153 over time. In the CSF, all three Fc-Fab fusions were able to significantly reduce both Aβ40 and sAPPβ/sAPPα ratio to about 70% compared to control IgG_Ab122, whereas no significant reduction was observed in animals dosed with Ab153 (FIGS. 46C and 46D). These results demonstrate that binding to TfR with a CH3C variant polypeptide (e.g., clone CH3C.35.21.16 and CH3C.35.21) enhances CNS penetration of an Fc-Fab fusion comprising the CH3C variant polypeptide fused to the Fab domain of an anti-BACE1 antibody (e.g., CH3C.35.21.16: Ab153 and CH3C.35.21:Ab153) to inhibit CSF Aβ40 and sAPPβ/sAPPα production.

Figure 47A:
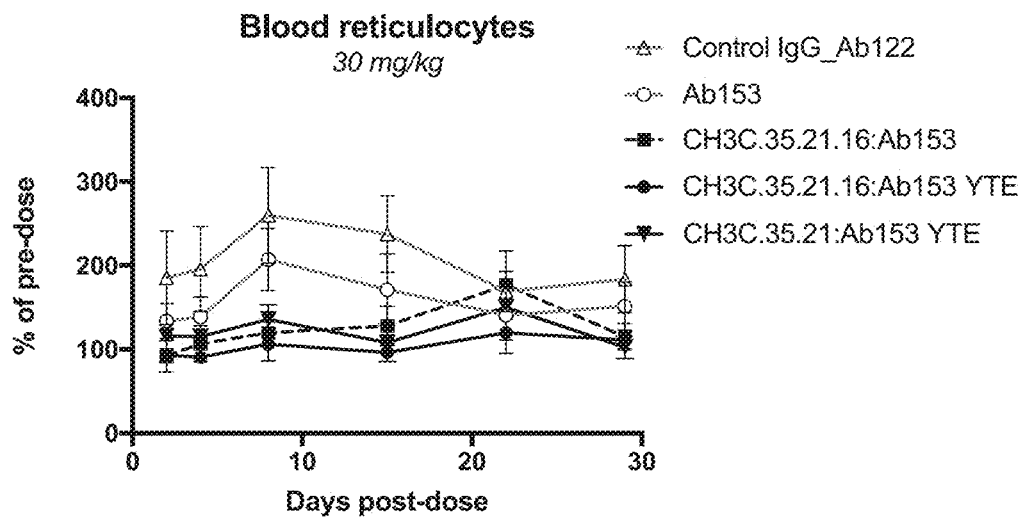
FIGS. 47A-47C depict blood reticulocyte relative to pre-dose levels (FIG. 47A), absolute serum iron levels (FIG. 47B), and absolute red blood cell count (FIG. 47C) in peripheral blood in cynomolgus monkeys after a single 30 mg/kg dose of the indicated proteins (mean±SEM, n=4-5 per group).
Figure 47B:
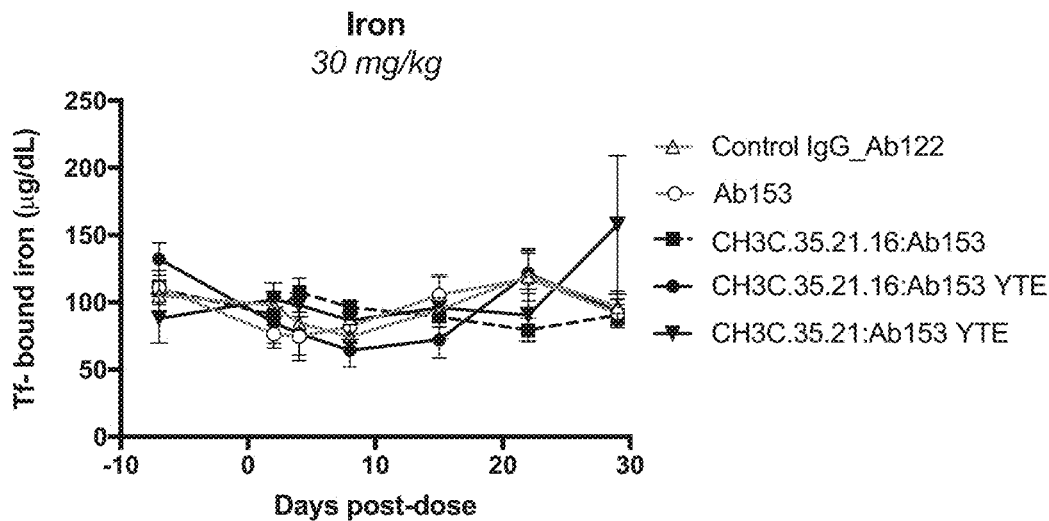
Figure 47C:
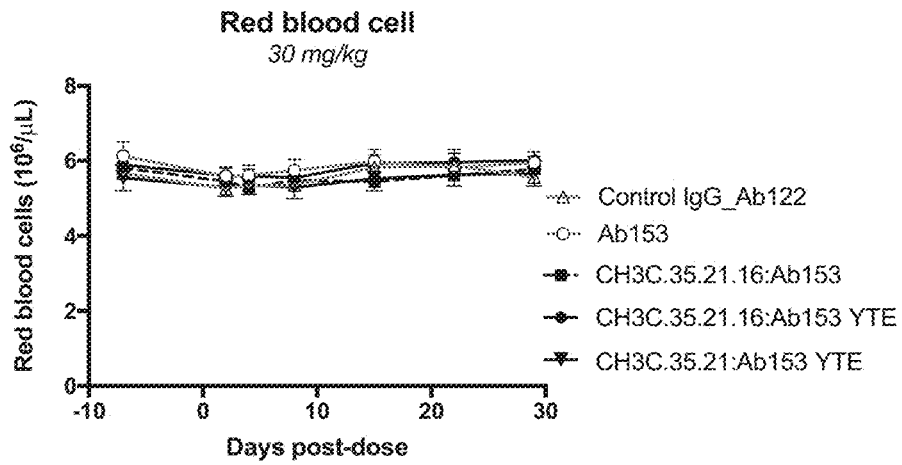

Because of the high level of TfR expression on immature red blood cells, peripheral blood clinical pathology was evaluated throughout the course of the study to evaluate reticulocyte number, serum iron, and red blood cell count. The assessment of serum iron levels utilized a variation of the method using TPTZ [2,4,6-Tri-(2-pyridyl)-5-triazine] as the chromogen. In an acidic medium, transferrin-bound iron dissociated into free ferric ions and apo transferrin. Hydrochloric acid and sodium ascorbate reduced the ferric ions to the ferrous state. The ferrous ions then reacted with TPTZ to form a blue colored complex that was measured bichromatically at 600/800 nm. The increase in absorbance was directly proportional to the amount of transferrin bound iron present. This is performed on the Beckman/Olympus AU640e chemistry analyzer. Absolute reticulocytes and RBC morphology were analyzed by the Siemens Advia 120 automated hematology system. Fc-Fab fusions had no impact on reticulocyte number, as compared to their pre-dose values (FIG. 47A). Additionally, serum iron as well as red blood cell number were also not impacted (FIGS. 47B and 47C). Together these data indicate that modified TfR-binding Fc polypeptide-Fab fusions can safely and effectively increase brain exposure of antibodies in non-human primates to produce a robust pharmacodynamic response (i.e., CSF Aβ reduction).

Example 9

Pharmacokinetic Analysis of CH3C.35 Containing M201L and N207S Mutations

This example describes that mutations M201L and N207S are compatible with CH3C.35.

In order to evaluate whether mutations that increase serum stability, M201L and N207S as numbered with reference to SEQ ID NO: 1 (M428L/N4345 according to EU numbering; also referred to as "LS" mutations), are compatible with TfR-binding Fc modifications, human FcRn knock-in mice were dosed with Ab153_LALAPG, Ab153_LALA.LS, CH3C.35.21:Ab153_LALA.LS, or Ab153_LALAPG.YTE at 10 mg/kg. Plasma PK evaluation over 14 days showed a similar about 2-fold improvement for Ab153_LALA.LS, CH3C.35.21:Ab153_LALA.LS, and Ab153_LALAPG.YTE compared to Ab153_LALAPG without any serum stability mutations (FIGS. 48A and 48B). This indicates that the additional Fc mutations for TfR binding do not impact the ability of the LS mutations to improve huIgG1 half-life in vivo.

Example 10

Single Amino Acid Substitution of CH3C.35.21

This example describes the construction of a library of CH3C.35.21 single amino acid mutants.
Methods A library of CH3C.35.21 mutants each containing a single amino acid substitution of CH3C.35.21 was constructed using Kunkel mutagenesis (Kunkel, Proc. Natl. Acad. Sci. USA. 82(2):488-92, 1985). For each position of CH3C.35.21, W153, Y157, T159, E160, W161, S162, S163, K165, T186, K187, E188, E189, F194, S197, and S199, as numbered according to SEQ ID NO:1 (W380, Y384, T386, E387, W388, 5389, 5390, K392, T413, K414, E415, E416, F421, 5424, and 5426, as numbered according to the EU numbering scheme) were mutated individually to the codon NNK using degenerate mutagenic oligos. To avoid obtaining the original CH3C.35.21 clone in the library, the single-stranded DNA (ssDNA) Kunkel template encoded a wild-type IgG1 Fc was used. Two mutagenic oligos (one with an NNK and the other encoding the other CH3C.35.21 region) were used in combination so that when both oligos were incorporated it yielded the CH3C.35.21 amino acid sequence, but with an NNK codon at the desired library positon. Because the template is a wild-type Fc, a single oligo insertion or no oligo insertion will not bind TfR, therefore, these constructs were easily eliminated from any analysis. Similarly, stop codons arising from the NNK positon were excluded. Libraries were transfected into EBY100 yeast. Eight colonies were sequenced from each library to ensure the naïve library contains the desired position randomization.

The top approximately 10% of the circularly permuted TfR apical domain bound population measured by yeast display and flow cytometry, were collected at a TfR concentration providing the best range for distinguishing affinities. Sequences were obtained for 12 clones for each positon. For libraries with distinct populations, the same experiment was done with better defined high, medium, low gates. There were 36 clones sequenced for each collected population. Further, in order to compare the binding of a mutant to the binding of the corresponding mutant having the wild-type residue at the corresponding amino acid position, the amino acid at the same position was reverted back to the wild-type IgG1 residue using a mutagenic oligo in similar methods.

Table 20 shows the library of CH3C.35.21 mutants. Each mutant contained a single amino acid substitution of CH3C.35.21. For example, one mutant may contain W380E and the amino acids at the rest of the positions are the same as those in CH3C.35.21. The positions shown in Table 20 are numbered according to the EU numbering scheme.

TABLE 20

CH3C.35.21 single amino acid mutants

| Position | 380 | 384 | 386 | 387 | 388 | 389 | 390 | 413 | 415 | 416 | 421 | 424 | 426 |
|---|---|---|---|---|---|---|---|---|---|---|---|---|---|
| Wild-typeFc | E | N | Q | P | E | N | N | D | S | R | N | S | S |
| CH3C.35.21 | W | Y | T | E | W | S | S | T | E | E | F | S | S |
| Residues found to have affinity in the range: <190 nM to about ~500 nM | E | Y | T | E | W | S | S | T | S | E | F | S | S |
|  | L | F | N | I |  | A | N | H | D | R | H | T | C |
|  | S | M | V | P |  | I | R | S | G |  | K | W | P |
|  | V | P |  | V |  | T | T | T |  |  | Y |  | M |
|  | W | V |  |  |  | V |  |  | P |  |  |  | W |
|  | Y | W |  |  |  |  |  |  | Q |  |  |  |  |
|  |  |  |  |  |  |  |  |  | R |  |  |  |  |

Example 11

Construction of CH3C.18 Variants

This example describes the construction of a library of CH3C.18 variants.

Figure 49:
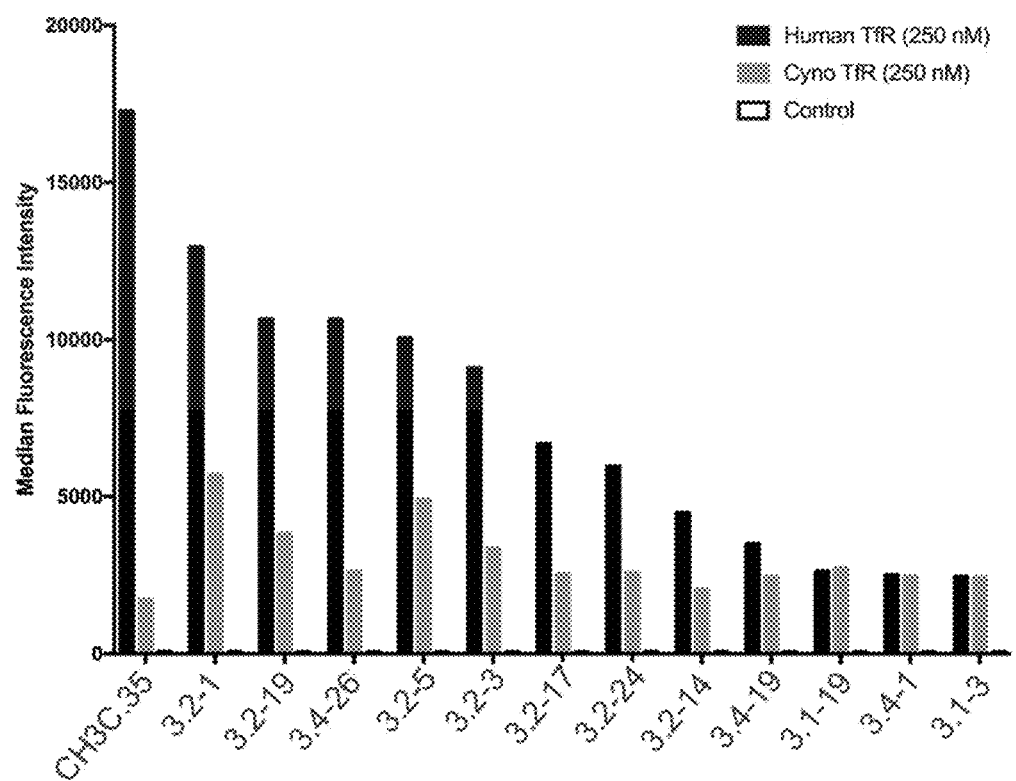
FIG. 49 depicts the median fluorescence intensity of TfR-binding CH3C.18 variants.

Single clones were isolated, and grown overnight in SG-CAA media supplemented with 0.2% glucose overnight to induce surface expression of CH3C.18 variants. For each clone, two million cells were washed three times in PBS+ 0.5% BSA at pH 7.4. Cells were stained with biotinylated target, 250 nM human TfR, 250 nM cyno TfR, or 250 nM of an unrelated biotinylated protein for 1 hour at 4° C. with shaking, then washed twice with the same buffer. Cells were stained with nuetravidin-Alexafluor647 (AF647) for 30 minutes at 4° C., then washed twice again. Expression was measured using anti-c-myc antibody with anti-chicken—Alexfluor488 (AF488) secondary antibody. Cells were resuspended, and median fluorescence intensity (MFI) of AF647 and AF488 was measured on a BD FACS CantoII. MFI was calculated for the TfR-binding population for each population and plotted with human TfR, cyno TfR, or control binding (FIG. 49).

Table 21 shows the library of CH3C.18 variants. Each row represents a variant that contains the indicated amino acid substitutions at each position and the amino acids at the rest of the positions are the same as those in the wild-type Fc. The positions shown in Table 21 are numbered according to the EU numbering scheme.

TABLE 21

CH3C.18 variants

| Position | 384 | 386 | 387 | 389 | 390 | 391 | 413 | 416 | 421 |
|---|---|---|---|---|---|---|---|---|---|
| Wild-type Fc | N | Q | P | N | N | Y | D | R | N |
| CH3C.4 (CH3C.18.1) | V | T | P | A | L | Y | L | E | W |
| CH3C.2 (CH3C.18.2) | Y | T | V | S | H | Y | S | E | Y |
| CH3C.3 (CH3C.18.3) | Y | T | E | S | Q | Y | E | D | H |
| CH3C.1 (CH3C.18.4) | L | L | V | V | G | Y | A | T | W |
| CH3C.18 (CH3C.18.1.18) | L | H | V | A | V | Y | P | T | W |
| CH3C.3.1-3 (CH3C.18.3.1-3) | L | H | V | V | A | T | P | T | W |
| CH3C.3.1-9 (CH3C.18.3.1-9) | L | P | V | V | H | T | P | T | W |
| CH3C.3.2-1 (CH3C.18.3.2-1) | L | H | V | V | N | F | P | T | W |
| CH3C.3.2-5 (CH3C.18.3.2-5) | L | H | V | V | D | Q | P | T | W |
| CH3C.3.2-19 (CH3C.18.3.2-19) | L | H | V | V | N | Q | P | T | W |
| CH3C.3.4-1 (CH3C.18.3.4-1) | W | F | V | S | T | T | P | N | F |
| CH3C.3.4-19 (CH3C.18.3.4-19) | W | H | V | S | T | T | P | N | Y |
| CH3C.3.2-3 (CH3C.18.3.2-3) | L | H | V | V | E | Q | P | T | W |
| CH3C.3.2-14 (CH3C.18.3.2-14) | L | H | V | V | G | V | P | T | W |

TABLE 21-continued

CH3C.18 variants

| Position | 384 | 386 | 387 | 389 | 390 | 391 | 413 | 416 | 421 |
|---|---|---|---|---|---|---|---|---|---|
| CH3C.3.2-24 (CH3C.18.3.2-24) | L | H | V | V | H | T | P | T | W |
| CH3C.3.4-26 (CH3C.18.3.4-26) | W | T | V | G | T | Y | P | N | Y |
| CH3C.3.2-17 (CH3C.18.3.2-17) | L | H | V | V | G | T | P | T | W |

The amino acid substitutions for each clone described in the Tables (e.g., Table 9) dictate the amino acid substitutions at the register positions of that clone over the amino acids found in the sequence set forth in the Sequence Listing, in case of discrepancy.

It is understood that the examples and embodiments described herein are for illustrative purposes only and that various modifications or changes in light thereof will be suggested to persons skilled in the art and are to be included within the spirit and purview of this application and scope of the appended claims. The sequences of the sequence accession numbers cited herein are hereby incorporated by reference.

TABLE 1

CH2A2 Register Positions and Mutations

| Sequence name | Seq. group | 47 | 48 | 49 | ... | 56 | 57 | 58 | 59 | 60 | 61 | 62 | 63 |
|---|---|---|---|---|---|---|---|---|---|---|---|---|---|
| Wild-type | n/a | K | F | N | ... | E | V | H | N | A | K | T | K |
| CH2A2.1 | 1 | E | F | I | ... | D | V | R | Y | E | W | Q | L |
| CH2A2.2 | 1 | G | F | V | ... | P | V | S | W | E | W | Y | W |
| CH2A2.3 | 1 | Q | F | D | ... | M | V | R | R | E | W | H | R |
| CH2A2.4 | 1 | S | F | E | ... | P | V | R | W | E | W | Q | W |
| CH2A2.5 | 1 | A | F | T | ... | P | V | R | W | E | W | Q | N |
| CH2A2.6 | 1 | N | F | D | ... | L | V | R | R | E | W | H | R |
| CH2A2.7 | 1 | Q | F | V | ... | A | V | R | W | E | W | I | R |
| CH2A2.8 | 1 | E | F | I | ... | E | V | A | W | E | W | F | W |
| CH2A2.9 | 1 | G | F | A | ... | N | V | R | V | E | W | Q | Y |
| CH2A2.10 | 1 | G | F | V | ... | E | V | R | R | E | W | V | R |
| CH2A2.11 | 1 | S | F | D | ... | L | V | R | R | E | W | Q | R |
| CH2A2.12 | 1 | E | F | T | ... | D | V | R | Y | E | W | Y | Y |
| CH2A2.13 | 1 | Q | F | T | ... | D | V | R | Y | E | W | V | R |
| CH2A2.14 | 1 | Q | F | Y | ... | N | V | R | R | E | W | H | R |
| CH2A2.15 | 1 | Y | F | D | ... | M | V | R | R | E | W | H | R |
| CH2A2.16 | 2 | W | F | E | ... | F | V | G | V | A | Y | D | V |

TABLE 2

CH2C Register Positions and Mutations

| Sequence name | Seq. group | 39 | 40 | 41 | 42 | 43 | 44 | ... | 68 | 69 | 70 | 71 | 72 |
|---|---|---|---|---|---|---|---|---|---|---|---|---|---|
| Wild-type | n/a | V | S | H | E | D | P | ... | Q | Y | N | S | T |
| CH2C.1 | 1 | P | Q | T | P | P | W | ... | E | Y | Y | T | Y |
| CH2C.2 | 1 | P | P | S | P | P | W | ... | E | Y | Y | S | N |
| CH2C.3 | 1 | P | Q | T | P | P | W | ... | E | Y | Y | S | N |
| CH2C.4 | 1 | F | R | G | P | P | W | ... | E | Y | Y | H | D |
| CH2C.5 | 1 | P | Q | T | V | P | W | ... | E | Y | Y | S | N |
| CH2C.6 | 1 | P | K | M | P | P | W | ... | E | Y | Y | T | Y |
| CH2C.7 | 1 | P | P | V | P | P | W | ... | E | Y | Y | S | N |
| CH2C.8 | 1 | P | A | F | P | P | W | ... | E | Y | Y | Q | N |
| CH2C.9 | 1 | A | I | W | P | P | W | ... | E | Y | Y | S | N |
| CH2C.10 | 1 | P | P | V | A | P | W | ... | E | Y | Y | S | S |
| CH2C.11 | 1 | P | Q | M | P | P | Q | ... | E | Y | Y | S | N |
| CH2C.12 | 1 | P | Q | T | A | P | W | ... | E | Y | Y | T | Y |
| CH2C.13 | 1 | P | Q | T | P | P | Q | ... | E | Y | Y | S | N |
| CH2C.14 | 1 | P | Q | T | P | P | W | ... | E | Y | Y | T | Y |
| CH2C.15 | 1 | P | R | V | P | P | W | ... | E | Y | Y | Q | N |
| CH2C.16 | 1 | P | S | V | P | P | W | ... | E | Y | Y | S | N |
| CH2C.17 | 2 | M | L | W | P | V | P | ... | V | Y | H | R | P |
| CH2C.18 | 2 | M | L | W | P | V | P | ... | T | Y | H | N | P |
| CH2C.19 | 2 | M | E | W | P | V | T | ... | T | Y | H | H | P |
| CH2C.20 | 2 | M | L | W | P | V | P | ... | T | Y | H | H | P |
| CH2C.21 | 3 | D | D | L | T | F | Q | ... | V | Y | V | T | P |
| CH2C.22 | 3 | D | D | L | T | F | Q | ... | L | Y | V | T | P |
| CH2C.23 | 4 | A | Y | G | D | P | E | ... | W | Y | D | V | P |

TABLE 3

CH2D Register Positions and Mutations

| Sequence name | Seq. group | 41 | 42 | 43 | 44 | 45 | ... | 65 | 66 | 67 | 68 | 69 | 70 | 71 | 72 | 73 |
|---|---|---|---|---|---|---|---|---|---|---|---|---|---|---|---|---|
| Wild-type | n/a | H | E | D | P | E | ... | R | E | E | Q | Y | N | S | T | Y |
| CH2D.1 | 1 | V | P | P | R | M | ... | L | T | S | Q | H | N | S | T | V |
| CH2D.2 | 1 | V | P | P | W | M | ... | L | T | S | Q | H | N | S | T | V |
| CH2D.3 | 2 | D | M | W | E | Y | ... | W | V | K | Q | L | N | S | T | W |
| CH2D.4 | 2 | D | D | W | T | W | ... | W | I | A | Q | P | N | S | T | W |
| CH2D.5 | 2 | D | D | W | E | W | ... | W | K | L | Q | L | N | S | T | W |

TABLE 4

CH2E3 Register Positions and Mutations

| Sequence name | Seq. group | 45 | 46 | 47 | 48 | 49 | ... | 95 | 96 | 97 | 98 | 99 | 100 | 101 | 102 | 103 | 104 |
|---|---|---|---|---|---|---|---|---|---|---|---|---|---|---|---|---|---|
| Wild-type | n/a | E | V | K | F | N | ... | K | V | S | N | K | A | L | P | A | P |
| CH2E3.1 | 1 | W | V | W | F | Y | ... | S | V | V | N | I | A | L | W | W | S |
| CH2E3.2 | 2 | V | V | G | F | R | ... | R | V | S | N | S | A | L | T | W | K |
| CH2E3.3 | 2 | V | V | G | F | R | ... | R | V | S | N | S | A | L | S | W | R |
| CH2E3.4 | 2 | I | V | G | F | R | ... | R | V | S | N | S | A | L | R | W | R |
| CH2E3.5 | 3 | A | V | G | F | E | ... | Q | V | F | N | W | A | L | D | W | V |

TABLE 5

CH3B Register Positions and Mutations

| Sequence namex | Seq. group | 118 | 119 | 120 | 121 | 122 | ... | 210 | 211 | 212 | 213 |
|---|---|---|---|---|---|---|---|---|---|---|---|
| Wild-type | n/a | E | P | Q | V | Y | ... | T | Q | K | S |
| CH3B.1 | 1 | F | D | Y | V | T | ... | G | F | H | D |
| CH3B.2 | 1 | F | D | M | V | T | ... | G | F | H | D |
| CH3B.3 | 1 | F | E | Y | V | T | ... | G | F | H | D |
| CH3B.4 | 1 | F | E | M | V | T | ... | G | F | H | D |
| CH3B.5 | 1 | F | E | L | V | T | ... | G | F | H | D |
| CH3B.6 | 1 | F | E | I | V | T | ... | G | F | H | D |
| CH3B.7 | 1 | F | D | I | V | T | ... | G | F | H | D |
| CH3B.8 | 1 | F | D | Y | V | T | ... | G | F | H | D |
| CH3B.9 | 1 | F | G | M | V | T | ... | G | F | H | D |
| CH3B.10 | 1 | F | A | D | V | T | ... | G | F | Y | D |
| CH3B.11 | 1 | F | G | L | V | T | ... | G | F | H | D |
| CH3B.12 | 1 | F | D | Y | V | T | ... | G | F | S | D |
| CH3B.13 | 1 | I | D | Y | V | T | ... | G | F | S | D |
| CH3B.14 | 1 | F | K | D | V | T | ... | G | F | F | D |
| CH3B.15 | 1 | F | D | L | V | T | ... | G | F | Y | D |
| CH3B.16 | 1 | I | D | Y | V | T | ... | G | F | S | D |
| CH3B.17 | 1 | F | E | L | V | A | ... | G | F | H | D |

TABLE 6

CH3C Register Positions and Mutations

| Sequence name | Seq. group | 157 | 158 | 159 | 160 | 161 | 162 | 163 | 164 | ... | 186 | 187 | 188 | 189 | 190 | 191 | 192 | 193 | 194 |
|---|---|---|---|---|---|---|---|---|---|---|---|---|---|---|---|---|---|---|---|
| Wild-type | n/a | N | G | Q | P | E | N | N | Y | ... | D | K | S | R | W | Q | Q | G | N |
| CH3C.1 | | L | G | L | V | W | V | G | Y | ... | A | K | S | T | W | Q | Q | G | W |
| CH3C.2 | | Y | G | T | V | W | S | H | Y | ... | S | K | S | E | W | Q | Q | G | Y |
| CH3C.3 | | Y | G | T | E | W | S | Q | Y | ... | E | K | S | D | W | Q | Q | G | H |
| CH3C.4 | | V | G | T | P | W | A | L | Y | ... | L | K | S | E | W | Q | Q | G | W |
| CH3C.17 | 2 | Y | G | T | V | W | S | K | Y | ... | S | K | S | E | W | Q | Q | G | F |
| CH3C.18 | 1 | L | G | H | V | W | A | V | Y | ... | P | K | S | T | W | Q | Q | G | W |
| CH3C.21 | 1 | L | G | L | V | W | V | G | Y | ... | P | K | S | T | W | Q | Q | G | W |

TABLE 6-continued

CH3C Register Positions and Mutations

| Sequence name | Seq. group | 157 | 158 | 159 | 160 | 161 | 162 | 163 | 164 | ... | 186 | 187 | 188 | 189 | 190 | 191 | 192 | 193 | 194 |
|---|---|---|---|---|---|---|---|---|---|---|---|---|---|---|---|---|---|---|---|
| CH3C.25 | 1 | M | G | H | V | W | V | G | Y | ... | D | K | S | T | W | Q | Q | G | W |
| CH3C.34 | 1 | L | G | L | V | W | V | F | S | ... | P | K | S | T | W | Q | Q | G | W |
| CH3C.35 | 2 | Y | G | T | E | W | S | S | Y | ... | T | K | S | E | W | Q | Q | G | F |
| CH3C.44 | 2 | Y | G | T | E | W | S | N | Y | ... | S | K | S | E | W | Q | Q | G | F |
| CH3C.51 | 1/2 | L | G | H | V | W | V | G | Y | ... | S | K | S | E | W | Q | Q | G | W |
| CH3C.3.1-3 | 1 | L | G | H | V | W | V | A | T | ... | P | K | S | T | W | Q | Q | G | W |
| CH3C.3.1-9 | 1 | L | G | P | V | W | V | H | T | ... | P | K | S | T | W | Q | Q | G | W |
| CH3C.3.2-5 | 1 | L | G | H | V | W | V | D | Q | ... | P | K | S | T | W | Q | Q | G | W |
| CH3C.3.2-19 | 1 | L | G | H | V | W | V | N | Q | ... | P | K | S | T | W | Q | Q | G | W |
| CH3C.3.2-1 | 1 | L | G | H | V | W | V | N | F | ... | P | K | S | T | W | Q | Q | G | W |
| CH3C.3.4-1 | | W | G | F | V | W | S | T | Y | | P | K | S | N | W | Q | Q | G | F |
| CH3C.3.4-19 | | W | G | H | V | W | S | T | Y | | P | K | S | N | W | Q | Q | G | Y |
| CH3C.3.2-3 | | L | G | H | V | W | V | E | Q | | P | K | S | T | W | Q | Q | G | W |
| CH3C.3.2-14 | | L | G | H | V | W | V | G | V | | P | K | S | T | W | Q | Q | G | W |
| CH3C.3.2-24 | | L | G | H | V | W | V | H | T | | P | K | S | I | W | Q | Q | G | W |
| CH3C.3.4-26 | | W | G | T | V | W | G | T | Y | | P | K | S | N | W | Q | Q | G | Y |
| CH3C.3.2-17 | | L | G | H | V | W | V | G | T | | P | K | S | T | W | Q | Q | G | W |

TABLE 9

Exploration of Acceptable Diversity Within Register and Hot Spot Positions for CH3C.35.21

| | 151 | 152 | 153 | 154 | 155 | 156 | 157 | 158 | 159 | 160 | 161 | 162 | 163 | 164 | 165 |
|---|---|---|---|---|---|---|---|---|---|---|---|---|---|---|---|
| Wild-type | A | V | E | W | E | S | N | G | Q | P | E | N | N | Y | K |
| CH3C.35.20.1 | . | . | . | . | . | . | F | . | T | E | W | S | S. | . | . |
| CH3C.35.20.2 | . | . | . | . | . | . | Y | . | T | E | W | A | S | . | . |
| CH3C.35.20.3 | . | . | . | . | . | . | Y | . | T | E | W | V | S | . | . |
| CH3C.35.20.4 | . | . | . | . | . | . | Y | . | T | E | W | S | S | . | . |
| CH3C.35.20.5 | . | . | . | . | . | . | F | . | T | E | W | A | S | . | . |
| CH3C.35.20.6 | . | . | . | . | . | . | F | . | T | E | W | V | S | . | . |
| CH3C.35.21.a.1 | . | . | W | . | . | . | F | . | T | E | W | S | S | . | . |
| CH3C.35.21.a.2 | . | . | W | . | . | . | Y | . | T | E | W | A | S | . | . |
| CH3C.35.21.a.3 | . | . | W | . | . | . | Y | . | T | E | W | V | S | . | . |
| CH3C.35.21.a.4 | . | . | W | . | . | . | Y | . | T | E | W | S | S | . | . |
| CH3C.35.21.a.5 | . | . | W | . | . | . | F | . | T | E | W | A | S | . | . |
| CH3C.35.21.a.6 | . | . | W | . | . | . | F | . | T | E | W | V | S | . | . |
| CH3C.35.23.1 | . | . | . | . | . | . | F | . | T | E | W | S | . | . | . |
| CH3C.35.23.2 | . | . | . | . | . | . | Y | . | T | E | W | A | . | . | . |
| CH3C.35.23.3 | . | . | . | . | . | . | Y | . | T | E | W | V | . | . | . |
| CH3C.35.23.4 | . | . | . | . | . | . | Y | . | T | E | W | S | . | . | . |
| CH3C.35.23.5 | . | . | . | . | . | . | F | . | T | E | W | A | . | . | . |
| CH3C.35.23.6 | . | . | . | . | . | . | F | . | T | E | W | V | . | . | . |
| CH3C.35.24.1 | . | . | W | . | . | . | F | . | T | E | W | S | . | . | . |
| CH3C.35.24.2 | . | . | W | . | . | . | Y | . | T | E | W | A | . | . | . |
| CH3C.35.24.3 | . | . | W | . | . | . | Y | . | T | E | W | V | . | . | . |
| CH3C.35.24.4 | . | . | W | . | . | . | Y | . | T | E | W | S | . | . | . |
| CH3C.35.24.5 | . | . | W | . | . | . | F | . | T | E | W | A | . | . | . |
| CH3C.35.24.6 | . | . | W | . | . | . | F | . | T | E | W | V | . | . | . |
| CH3C.35.21.17.1 | . | . | L | . | . | . | F | . | T | E | W | S | S | . | . |
| CH3C.35.21.17.2 | . | . | L | . | . | . | Y | . | T | E | W | A | S | . | . |
| CH3C.35.21.17.3 | . | . | L | . | . | . | Y | . | T | E | W | V | S | . | . |
| CH3C.35.21.17.4 | . | . | L | . | . | . | Y | . | T | E | W | S | S | . | . |
| CH3C.35.21.17.5 | . | . | L | . | . | . | F | . | T | E | W | A | S | . | . |
| CH3C.35.21.17.6 | . | . | L | . | . | . | F | . | T | E | W | V | S | . | . |
| CH3C.35.20 | . | . | . | . | . | . | Y | . | T | E | W | S | S | . | . |
| CH3C.35.21 | . | . | W | . | . | . | Y | . | T | E | W | S | S | . | . |
| CH3C.35.22 | . | . | W | . | . | . | Y | . | T | E | W | S | . | . | . |
| CH3C.35.23 | . | . | . | . | . | . | Y | . | T | E | W | S | . | . | . |
| CH3C.35.24 | . | . | W | . | . | . | Y | . | T | E | W | S | . | . | . |
| CH3C.35.21.17 | . | . | L | . | . | . | Y | . | T | E | W | S | S | . | . |
| CH3C.35.N390 | | | | | | | Y | . | T | E | W | S | . | . | . |
| CH3C.35.20.1.1 | | | | | | | F | . | T | E | W | S | S | | |
| CH3C.35.23.2.1 | | | | | | | Y | . | T | E | W | A | | | |
| CH3C.35.23.1.1 | | | | | | | F | . | T | E | W | S | | | |

TABLE 9-continued

Exploration of Acceptable Diversity Within Register and Hot Spot Positions for CH3C.35.21

| | | | | | | | | | | | | | |
|---|---|---|---|---|---|---|---|---|---|---|---|---|---|
| CH3C.35.S413 | | | | | | Y | T | E | W | S | S | | |
| CH3C.35.23.3.1 | | | | | | Y | T | E | W | V | | | |
| CH3C.35.N390.1 | | | | | | Y | T | E | W | S | | | |
| CH3C.35.23.6.1 | | | | | | F | T | E | W | V | | | |

| | 184 | 185 | 186 | 187 | 188 | 189 | 190 | 191 | 192 | 193 | 194 | 195 | 196 |
|---|---|---|---|---|---|---|---|---|---|---|---|---|---|
| Wild-type | T | V | D | K | S | R | W | Q | Q | G | N | V | F |
| CH3C.35.20.1 | . | . | T. | . | E | E | . | . | . | . | F | . | . |
| CH3C.35.20.2 | . | . | T | . | E | E | . | . | . | . | F | . | . |
| CH3C.35.20.3 | . | . | T | . | E | E | . | . | . | . | F | . | . |
| CH3C.35.20.4 | . | . | S | . | E | E | . | . | . | . | F | . | . |
| CH3C.35.20.5 | . | . | T | . | E | E | . | . | . | . | F | . | . |
| CH3C.35.20.6 | . | . | T | . | E | E | . | . | . | . | F | . | . |
| CH3C.35.21.a.1 | . | . | T | . | E | E | . | . | . | . | F | . | . |
| CH3C.35.21.a.2 | . | . | T | . | E | E | . | . | . | . | F | . | . |
| CH3C.35.21.a.3 | . | . | T | . | E | E | . | . | . | . | F | . | . |
| CH3C.35.21.a.4 | . | . | S | . | E | E | . | . | . | . | F | . | . |
| CH3C.35.21.a.5 | . | . | T | . | E | E | . | . | . | . | F | . | . |
| CH3C.35.21.a.6 | . | . | T | . | E | E | . | . | . | . | F | . | . |
| CH3C.35.23.1 | . | . | T | . | E | E | . | . | . | . | F | . | . |
| CH3C.35.23.2 | . | . | T | . | E | E | . | . | . | . | F | . | . |
| CH3C.35.23.3 | . | . | T | . | E | E | . | . | . | . | F | . | . |
| CH3C.35.23.4 | . | . | S | . | E | E | . | . | . | . | F | . | . |
| CH3C.35.23.5 | . | . | T | . | E | E | . | . | . | . | F | . | . |
| CH3C.35.23.6 | . | . | T | . | E | E | . | . | . | . | F | . | . |
| CH3C.35.24.1 | . | . | T | . | E | E | . | . | . | . | F | . | . |
| CH3C.35.24.2 | . | . | T | . | E | E | . | . | . | . | F | . | . |
| CH3C.35.24.3 | . | . | T | . | E | E | . | . | . | . | F | . | . |
| CH3C.35.24.4 | . | . | S | . | E | E | . | . | . | . | F | . | . |
| CH3C.35.24.5 | . | . | T | . | E | E | . | . | . | . | F | . | . |
| CH3C.35.24.6 | . | . | T | . | E | E | . | . | . | . | F | . | . |
| CH3C.35.21.17.1 | . | . | T | . | E | E | . | . | . | . | F | . | . |
| CH3C.35.21.17.2 | . | . | T | . | E | E | . | . | . | . | F | . | . |
| CH3C.35.21.17.3 | . | . | T | . | E | E | . | . | . | . | F | . | . |
| CH3C.35.21.17.4 | . | . | S | . | E | E | . | . | . | . | F | . | . |
| CH3C.35.21.17.5 | . | . | T | . | E | E | . | . | . | . | F | . | . |
| CH3C.35.21.17.6 | . | . | T | . | E | E | . | . | . | . | F | . | . |
| CH3C.35.20 | . | . | T | . | E | E | . | . | . | . | F | . | . |
| CH3C.35.21 | . | . | T | . | E | E | . | . | . | . | F | . | |
| CH3C.35.22 | . | . | T | . | . | E | . | . | . | . | F | .. | |
| CH3C.35.23 | . | . | T | . | E | E | . | . | . | . | F | . | |
| CH3C.35.24 | . | . | T | . | E | E | . | . | . | . | F | . | |
| CH3C.35.21.17 | . | . | T | . | E | E | . | . | . | . | F | . | |
| CH3C.35.N390 | . | . | T | . | . | E | . | . | . | . | F | . | |
| CH3C.35.20.1.1 | | | S | | E | E | | | | | F | | |
| CH3C.35.23.2.1 | | | S | | . | E | | | | | F | | |
| CH3C.35.23.1.1 | | | S | | E | E | | | | | F | | |
| CH3C.35.S413 | | | S | | . | E | | | | | F | | |
| CH3C.35.23.3.1 | | | S | | E | E | | | | | F | | |
| CH3C.35.N390.1 | | | S | | . | E | | | | | F | | |
| CH3C.35.23.6.1 | | | S | | E | E | | | | | F | | |

Informal Sequence Listing

| SEQ ID NO: | Sequence | Description |
|---|---|---|
| 1 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Wild-type human Fc sequence amino acids 1-3 (PCP) are from a hinge region |
| 2 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAK | CH2 domain sequence, including three amino acids (PCP) at the N-terminus from the hinge region |

-continued

Informal Sequence Listing

| SEQ ID NO: | Sequence | Description |
|---|---|---|
| 3 | GQPREPQVYTLPPSRDELTKNQVSLTCLVKGFYPSDIAVEWESNGQP ENNYKTTPPVLDSDGSFFLYSKLTVDKSRWQQGNVFSCSVMHEALHN HYTQKSLSLSPGK | CH3 domain sequence |
| 4 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESLGLVWVGYKTTPPVLDSDGSFFLYSKLTVAKS TWQQGWVFSCSVMHEALHNHYTQKSLSLSPGK | Clone CH3C.1 (Clone CH3C.18.4) |
| 5 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGTVWSHYKTTPPVLDSDGSFFLYSKLTVSKS EWQQGYVFSCSVMHEALHNHYTQKSLSLSPGK | Clone CH3C.2 (Clone CH3C.18.2) |
| 6 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGIEWSQYKTTPPVLDSDGSFFLYSKLTVEKS DWQQGHVFSCSVMHEALHNHYTQKSLSLSPGK | Clone CH3C.3 (Clone CH3C.18.3) |
| 7 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESVGTPWALYKTTPPVLDSDGSFFLYSKLTVLKS EWQQGWVFSCSVMHEALHNHYTQKSLSLSPGK | Clone CH3C.4 (Clone CH3C.18.1) |
| 8 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGTVWSKYKTTPPVLDSDGSFFLYSKLTVSKS EWQQGFVFSCSVMHEALHNHYTQKSLSLSPGK | Clone CH3C.17 |
| 9 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESLGHVWAVYKTTPPVLDSDGSFFLYSKLTVPKS TWQQGWVFSCSVMHEALHNHYTQKSLSLSPGK | Clone CH3C.18 (Clone CH3C.18.1.18) |
| 10 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESLGLVWVGYKTTPPVLDSDGSFFLYSKLTVPKS TWQQGWVFSCSVMHEALHNHYTQKSLSLSPGK | Clone CH3C.21 |
| 11 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESMGHVWVGYKTTPPVLDSDGSFFLYSKLTVDKS TWQQGWVFSCSVMHEALHNHYTQKSLSLSPGK | Clone CH3C.25 |
| 12 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESLGLVWVFSKTTPPVLDSDGSFFLYSKLTVPKS TWQQGWVFSCSVMHEALHNHYTQKSLSLSPGK | Clone CH3C.34 |
| 13 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGIEWSSYKTTPPVLDSDGSFFLYSKLTVTKS EWQQGFVFSCSVMHEALHNHYTQKSLSLSPGK | Clone CH3C.35 |
| 14 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGIEWSNYKTTPPVLDSDGSFFLYSKLTVSKS EWQQGFVFSCSVMHEALHNHYTQKSLSLSPGK | Clone CH3C.44 |

| SEQ ID NO: | Sequence | Description |
|---|---|---|
| 15 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESLGHVWVGYKTTPPVLDSDGSFFLYSKLTVSKS<br>EWQQGWVFSCSVMHEALHNHYTQKSLSLSPGK | Clone CH3C.51 |
| 16 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESLGHVWVATKTTPPVLDSDGSFFLYSKLTVPKS<br>TWQQGWVFSCSVMHEALHNHYTQKSLSLSPGK | Clone CH3C.3.1-3<br>(Clone CH3C.18.3.1-3) |
| 17 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESLGPVWVHTKTTPPVLDSDGSFFLYSKLTVPKS<br>TWQQGWVFSCSVMHEALHNHYTQKSLSLSPGK | Clone CH3C.3.1-9<br>(Clone CH3C.18.3.1-9) |
| 18 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESLGHVWVDQKTTPPVLDSDGSFFLYSKLTVPKS<br>TWQQGWVFSCSVMHEALHNHYTQKSLSLSPGK | Clone CH3C.3.2-5<br>(Clone CH3C.18.3.2-5) |
| 19 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESLGHVWVNQKTTPPVLDSDGSFFLYSKLTVPKS<br>TWQQGWVFSCSVMHEALHNHYTQKSLSLSPGK | Clone CH3C.3.2-19<br>(Clone CH3C.18.3.2-19) |
| 20 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESLGHVWVNFKTTPPVLDSDGSFFLYSKLTVPKS<br>TWQQGWVFSCSVMHEALHNHYTQKSLSLSPGK | Clone CH3C.3.2-1<br>(Clone CH3C.18.3.2-1) |
| 21 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVVWESLGHVWAVYKTTPPVLDSDGSFFLYSKLTVPKS<br>TWQQGWVFSCSVMHEALHNHYTQKSLSLSPGK | Clone CH3C.18.E153W<br>(CH3C.35.13) |
| 22 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESLGHVWAVYQTTPPVLDSDGSFFLYSKLTVPKS<br>TWQQGWVFSCSVMHEALHNHYTQKSLSLSPGK | Clone CH3C.18.K165Q<br>(CH3C.35.14) |
| 23 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVVWESLGHVWAVYQTTPPVLDSDGSFFLYSKLTVPKS<br>TWQQGWVFSCSVMHEALHNHYTQKSLSLSPGK | Clone CH3C.18.E153W.K165Q<br>(CH3C.35.15) |
| 24 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESYGIEWSSYKTTPPVLDSDGSFFLYSKLTVTKS<br>EWQQGFVFSCSVMHEALHNHYTQKSLSLSPGK | Clone CH3C.35.E153W<br>(CH3C.35.19) |
| 25 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESYGIEWSSYKTTPPVLDSDGSFFLYSKLTVTKE<br>EWQQGFVFSCSVMHEALHNHYTQKSLSLSPGK | Clone CH3C.35.S188E<br>(CH3C.35.20) |
| 26 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESYGIEWSSYKTTPPVLDSDGSFFLYSKLTVTKE<br>EWQQGFVFSCSVMHEALHNHYTQKSLSLSPGK | Clone CH3C.35.E153W.S188E<br>(CH3C.35.21) |
| 27 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC | Clone CH3C.35.N163 |

| | | |
|---|---|---|
| SEQ ID NO: | Sequence | Description |
| | KVSNKALPAPIEKTISKAKGQPREPQVYTLPPSRDELTKNQVSLTCL VKGFYPSDIAVEWESYGIEWSNYKTTPPVLDSDGSFFLYSKLTVTKS EWQQGFVFSCSVMHEALHNHYTQKSLSLSPGK | |
| 28 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGIEWSSYQTTPPVLDSDGSFFLYSKLTVTKS EWQQGFVFSCSVMHEALHNHYTQKSLSLSPGK | Clone CH3C.35.K165Q |
| 29 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGIEWSNYQTTPPVLDSDGSFFLYSKLTVTKS EWQQGFVFSCSVMHEALHNHYTQKSLSLSPGK | Clone CH3C.35.N163.K165Q |
| 30 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPRFDYVTTLPPSRDELTKNQVSLTCL VKGFYPSDIAVEWESNGQPENNYKTTPPVLDSDGSFFLYSKLTVDKS RWQQGNVFSCSVMHEALHNHYGFHDLSLSPGK | Clone CH3B.1 |
| 31 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPRFDMVTTLPPSRDELTKNQVSLTCL VKGFYPSDIAVEWESNGQPENNYKTTPPVLDSDGSFFLYSKLTVDKS RWQQGNVFSCSVMHEALHNHYGFHDLSLSPGK | Clone CH3B.2 |
| 32 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPRFEYVTTLPPSRDELTKNQVSLTCL VKGFYPSDIAVEWESNGQPENNYKTTPPVLDSDGSFFLYSKLTVDKS RWQQGNVFSCSVMHEALHNHYGFHDLSLSPGK | Clone CH3B.3 |
| 33 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPRFEMVTTLPPSRDELTKNQVSLTCL VKGFYPSDIAVEWESNGQPENNYKTTPPVLDSDGSFFLYSKLTVDKS RWQQGNVFSCSVMHEALHNHYGFHDLSLSPGK | Clone CH3B.4 |
| 34 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPRFELVTTLPPSRDELTKNQVSLTCL VKGFYPSDIAVEWESNGQPENNYKTTPPVLDSDGSFFLYSKLTVDKS RWQQGNVFSCSVMHEALHNHYGFHDLSLSPGK | Clone CH3B.5 |
| 35 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPRFEIVTTLPPSRDELTKNQVSLTCL VKGFYPSDIAVEWESNGQPENNYKTTPPVLDSDGSFFLYSKLTVDKS RWQQGNVFSCSVMHEALHNHYGFHDLSLSPGK | Clone CH3B.6 |
| 36 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPRFDIVTTLPPSRDELTKNQVSLTCL VKGFYPSDIAVEWESNGQPENNYKTTPPVLDSDGSFFLYSKLTVDKS RWQQGNVFSCSVMHEALHNHYGFHDLSLSPGK | Clone CH3B.7 |
| 37 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPRFDYVTTLPPSRDELTKNQVSLTCL VKGFYPSDIAVEWESNGQPENNYKTTPPVLDSDGSFFLYSKLTVDKS RWQQGNVFSCSVMHEALHNHYGFHDLSLSPGK | Clone CH3B.8 |
| 38 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPRFGMVTTLPPSRDELTKNQVSLTCL VKGFYPSDIAVEWESNGQPENNYKTTPPVLDSDGSFFLYSKLTVDKS RWQQGNVFSCSVMHEALHNHYGFHDLSLSPGK | Clone CH3B.9 |

Informal Sequence Listing

| SEQ ID NO: | Sequence | Description |
|---|---|---|
| 39 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPRFADVTILPPSRDELTKNQVSLTCL<br>VKGFYPSDIAVEWESNGQPENNYKTTPPVLDSDGSFFLYSKLTVDKS<br>RWQQGNVFSCSVMHEALHNHYGFYDLSLSPGK | Clone CH3B.10 |
| 40 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPRFGLVTTLPPSRDELTKNQVSLTCL<br>VKGFYPSDIAVEWESNGQPENNYKTTPPVLDSDGSFFLYSKLTVDKS<br>RWQQGNVFSCSVMHEALHNHYGFHDLSLSPGK | Clone CH3B.11 |
| 41 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPRFDYVTTLPPSRDELTKNQVSLTCL<br>VKGFYPSDIAVEWESNGQPENNYKTTPPVLDSDGSFFLYSKLTVDKS<br>RWQQGNVFSCSVMHEALHNHYGFSDLSLSPGK | Clone CH3B.12 |
| 42 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPRIDYVTTLPPSRDELTKNQVSLTCL<br>VKGFYPSDIAVEWESNGQPENNYKTTPPVLDSDGSFFLYSKLTVDKS<br>RWQQGNVFSCSVMHEALHNHYGFSDLSLSPGK | Clone CH3B.13 |
| 43 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPRFKDVTILPPSRDELTKNQVSLTCL<br>VKGFYPSDIAVEWESNGQPENNYKTTPPVLDSDGSFFLYSKLTVDKS<br>RWQQGNVFSCSVMHEALHNHYGFFDLSLSPGK | Clone CH3B.14 |
| 44 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPRFDLVTILPPSRDELTKNQVSLTCL<br>VKGFYPSDIAVEWESNGQPENNYKTTPPVLDSDGSFFLYSKLTVDKS<br>RWQQGNVFSCSVMHEALHNHYGFYDLSLSPGK | Clone CH3B.15 |
| 45 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPRIDYVTTLPPSRDELTKNQVSLTCL<br>VKGFYPSDIAVEWESNGQPENNYKTTPPVLDSDGSFFLYSKLTVDKS<br>RWQQGNVFSCSVMHEALHNHYGFSDLSLSPGK | Clone CH3B.16 |
| 46 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPRFELVATLPPSRDELTKNQVSLTCL<br>VKGFYPSDIAVEWESNGQPENNYKTTPPVLDSDGSFFLYSKLTVDKS<br>RWQQGNVFSCSVMHEALHNHYGFHDLSLSPGK | Clone CH3B.17 |
| 47 | PCPAPELLGGPSVFLFPPKPKDTLMISRTPEVTCVVVDVSHEDPEVE<br>FIWYVDGVDVRYEWQLPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK | Clone CH2A2.1 |
| 48 | PCPAPELLGGPSVFLFPPKPKDTLMISRTPEVTCVVVDVSHEDPEVG<br>FVWYVDGVPVSWEWYWPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK | Clone CH2A2.2 |
| 49 | PCPAPELLGGPSVFLFPPKPKDTLMISRTPEVTCVVVDVSHEDPEVQ<br>FDWYVDGVMVRREWHRPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK | Clone CH2A2.3 |
| 50 | PCPAPELLGGPSVFLFPPKPKDTLMISRTPEVTCVVVDVSHEDPEVS<br>FEWYVDGVPVRWEWQWPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK | Clone CH2A2.4 |
| 51 | PCPAPELLGGPSVFLFPPKPKDTLMISRTPEVTCVVVDVSHEDPEVA<br>FTWYVDGVPVRWEWQNPREEQYNSTYRVVSVLTVLHQDWLNGKEYKC | Clone CH2A2.5 |

| SEQ ID NO: | Sequence | Description |
|---|---|---|
| | KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | |
| 52 | PCPAPELLGGPSVFLFPPKPKDTLMISRTPEVTCVVVDVSHEDPEVN FDWYVDGVLVRREWHRPREEQYNSTYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2A2.6 |
| 53 | PCPAPELLGGPSVFLFPPKPKDTLMISRTPEVTCVVVDVSHEDPEVQ FVWYVDGVAVRWEWIRPREEQYNSTYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2A2.7 |
| 54 | PCPAPELLGGPSVFLFPPKPKDTLMISRTPEVTCVVVDVSHEDPEVE FIWYVDGVEVAWEWFWPREEQYNSTYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2A2.8 |
| 55 | PCPAPELLGGPSVFLFPPKPKDTLMISRTPEVTCVVVDVSHEDPEVG FAWYVDGVNVRVEWQYPREEQYNSTYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2A2.9 |
| 56 | PCPAPELLGGPSVFLFPPKPKDTLMISRTPEVTCVVVDVSHEDPEVG FVWYVDGVEVRREWVRPREEQYNSTYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2A2.10 |
| 57 | PCPAPELLGGPSVFLFPPKPKDTLMISRTPEVTCVVVDVSHEDPEVS FDWYVDGVLVRREWQRPREEQYNSTYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2A2.11 |
| 58 | PCPAPELLGGPSVFLFPPKPKDTLMISRTPEVTCVVVDVSHEDPEVE FTWYVDGVDVRYEWYYPREEQYNSTYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2A2.12 |
| 59 | PCPAPELLGGPSVFLFPPKPKDTLMISRTPEVTCVVVDVSHEDPEVQ FTWYVDGVDVRYEWVRPREEQYNSTYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2A2.13 |
| 60 | PCPAPELLGGPSVFLFPPKPKDTLMISRTPEVTCVVVDVSHEDPEVQ FYWYVDGVNVRREWHRPREEQYNSTYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2A2.14 |
| 61 | PCPAPELLGGPSVFLFPPKPKDTLMISRTPEVTCVVVDVSHEDPEVY FDWYVDGVMVRREWHRPREEQYNSTYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2A2.15 |
| 62 | PCPAPELLGGPSVFLFPPKPKDTLMISRTPEVTCVVVDVSHEDPEVW FEWYVDGVFVGVAYDVPREEQYNSTYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2A2.16 |

Informal Sequence Listing

| SEQ ID NO: | Sequence | Description |
|---|---|---|
| 63 | PCPAPELLGGPSVFLFPPKPKDTLMISRTPEVTCVVVDPQTPPWEVK FNWYVDGVEVHNAKTKPREEEYYTYYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2C.1 |
| 64 | PCPAPELLGGPSVFLFPPKPKDTLMISRTPEVTCVVVDPPSPPWEVK FNWYVDGVEVHNAKTKPREEEYYSNYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2C.2 |
| 65 | PCPAPELLGGPSVFLFPPKPKDTLMISRTPEVTCVVVDPQTPPWEVK FNWYVDGVEVHNAKTKPREEEYYSNYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2C.3 |
| 66 | PCPAPELLGGPSVFLFPPKPKDTLMISRTPEVTCVVVDFRGPPWEVK FNWYVDGVEVHNAKTKPREEEYYHDYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2C.4 |
| 67 | PCPAPELLGGPSVFLFPPKPKDTLMISRTPEVTCVVVDPQTVPWEVK FNWYVDGVEVHNAKTKPREEEYYSNYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2C.5 |
| 68 | PCPAPELLGGPSVFLFPPKPKDTLMISRTPEVTCVVVDPKMPPWEVK FNWYVDGVEVHNAKTKPREEEYYTYYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2C.6 |
| 69 | PCPAPELLGGPSVFLFPPKPKDTLMISRTPEVTCVVVDPPVPPWEVK FNWYVDGVEVHNAKTKPREEEYYSNYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2C.7 |
| 70 | PCPAPELLGGPSVFLFPPKPKDTLMISRTPEVTCVVVDPAFPPWEVK FNWYVDGVEVHNAKTKPREEEYYQNYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2C.8 |
| 71 | PCPAPELLGGPSVFLFPPKPKDTLMISRTPEVTCVVVDAIWPPWEVK FNWYVDGVEVHNAKTKPREEEYYSNYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2C.9 |
| 72 | PCPAPELLGGPSVFLFPPKPKDTLMISRTPEVTCVVVDPPVAPWEVK FNWYVDGVEVHNAKTKPREEEYYSSYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2C.10 |
| 73 | PCPAPELLGGPSVFLFPPKPKDTLMISRTPEVTCVVVDPQMPPQEVK FNWYVDGVEVHNAKTKPREEEYYSNYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2C.11 |
| 74 | PCPAPELLGGPSVFLFPPKPKDTLMISRTPEVTCVVVDPQTAPWEVK FNWYVDGVEVHNAKTKPREEEYYTYYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2C.12 |
| 75 | PCPAPELLGGPSVFLFPPKPKDTLMISRTPEVTCVVVDPQTPPQEVK FNWYVDGVEVHNAKTKPREEEYYSNYRVVSVLTVLHQDWLNGKEYKC | Clone CH2C.13 |

| SEQ ID NO: | Sequence | Description |
|---|---|---|
|  | KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK |  |
| 76 | PCPAPELLGGPSVFLFPPKPKDTLMISRTPEVTCVVVDPQTPPWEVK<br>FNWYVDGVEVHNAKTKPREEEYYTYYRVVSVLTVLHQDWLNGKEYKC<br>KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK | Clone CH2C.14 |
| 77 | PCPAPELLGGPSVFLFPPKPKDTLMISRTPEVTCVVVDPRVPPWEVK<br>FNWYVDGVEVHNAKTKPREEEYYQNYRVVSVLTVLHQDWLNGKEYKC<br>KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK | Clone CH2C.15 |
| 78 | PCPAPELLGGPSVFLFPPKPKDTLMISRTPEVTCVVVDPSVPPWEVK<br>FNWYVDGVEVHNAKTKPREEEYYSNYRVVSVLTVLHQDWLNGKEYKC<br>KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK | Clone CH2C.16 |
| 79 | PCPAPELLGGPSVFLFPPKPKDTLMISRTPEVTCVVVDMLWPVPEVK<br>FNWYVDGVEVHNAKTKPREEVYHRPYRVVSVLTVLHQDWLNGKEYKC<br>KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK | Clone CH2C.17 |
| 80 | PCPAPELLGGPSVFLFPPKPKDTLMISRTPEVTCVVVDMLWPVPEVK<br>FNWYVDGVEVHNAKTKPREETYHNPYRVVSVLTVLHQDWLNGKEYKC<br>KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK | Clone CH2C.18 |
| 81 | PCPAPELLGGPSVFLFPPKPKDTLMISRTPEVTCVVVDMEWPVTEVK<br>FNWYVDGVEVHNAKTKPREETYHNPYRVVSVLTVLHQDWLNGKEYKC<br>KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK | Clone CH2C.19 |
| 82 | PCPAPELLGGPSVFLFPPKPKDTLMISRTPEVTCVVVDMLWPVPEVK<br>FNWYVDGVEVHNAKTKPREETYHHPYRVVSVLTVLHQDWLNGKEYKC<br>KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK | Clone CH2C.20 |
| 83 | PCPAPELLGGPSVFLFPPKPKDTLMISRTPEVTCVVVDDDLTFQEVK<br>FNWYVDGVEVHNAKTKPREEVYVTPYRVVSVLTVLHQDWLNGKEYKC<br>KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK | Clone CH2C.21 |
| 84 | PCPAPELLGGPSVFLFPPKPKDTLMISRTPEVTCVVVDDDLTFQEVK<br>FNWYVDGVEVHNAKTKPREELYVTPYRVVSVLTVLHQDWLNGKEYKC<br>KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK | Clone CH2C.22 |
| 85 | PCPAPELLGGPSVFLFPPKPKDTLMISRTPEVTCVVVDAYGDPEEVK<br>FNWYVDGVEVHNAKTKPREEWYDVPYRVVSVLTVLHQDWLNGKEYKC<br>KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK | Clone CH2C.23 |
| 86 | PCPAPELLGGPSVFLFPPKPKDTLMISRTPEVTCVVVDVSVPPRMVK<br>FNWYVDGVEVHNAKTKSLTSQHNSTVRVVSVLTVLHQDWLNGKEYKC<br>KVSNKALPAPIEKTISKAKGQPREPQVYTLPPSRDELTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGK | Clone CH2D.1 |

Informal Sequence Listing

| SEQ ID NO: | Sequence | Description |
|---|---|---|
| 87 | PCPAPELLGGPSVFLFPPKPKDTLMISRTPEVTCVVVDVSVPPWMVK FNWYVDGVEVHNAKTKSLTSQHNSTVRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2D.2 |
| 88 | PCPAPELLGGPSVFLFPPKPKDTLMISRTPEVTCVVVDVSDMWEYVK FNWYVDGVEVHNAKTKPWVKQLNSTWRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2D.3 |
| 89 | PCPAPELLGGPSVFLFPPKPKDTLMISRTPEVTCVVVDVSDDWTWVK FNWYVDGVEVHNAKTKPWIAQPNSTWRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2D.4 |
| 90 | PCPAPELLGGPSVFLFPPKPKDTLMISRTPEVTCVVVDVSDDWEWVK FNWYVDGVEVHNAKTKPWKLQLNSTWRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2D.5 |
| 91 | PCPAPELLGGPSVFLFPPKPKDTLMISRTPEVTCVVVDVSHEDPWVW FYWYVDGVEVHNAKTKPREEQYNSTYRVVSVLTVLHQDWLNGKEYKC SVVNIALWWSIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2E3.1 |
| 92 | PCPAPELLGGPSVFLFPPKPKDTLMISRTPEVTCVVVDVSHEDPVVG FRWYVDGVEVHNAKTKPREEQYNSTYRVVSVLTVLHQDWLNGKEYKC RVSNSALTWKIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2E3.2 |
| 93 | PCPAPELLGGPSVFLFPPKPKDTLMISRTPEVTCVVVDVSHEDPVVG FRWYVDGVEVHNAKTKPREEQYNSTYRVVSVLTVLHQDWLNGKEYKC RVSNSALSWRIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2E3.3 |
| 94 | PCPAPELLGGPSVFLFPPKPKDTLMISRTPEVTCVVVDVSHEDPIVG FRWYVDGVEVHNAKTKPREEQYNSTYRVVSVLTVLHQDWLNGKEYKC RVSNSALRWRIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2E3.4 |
| 95 | PCPAPELLGGPSVFLFPPKPKDTLMISRTPEVTCVVVDVSHEDPAVG FEWYVDGVEVHNAKTKPREEQYNSTYRVVSVLTVLHQDWLNGKEYKC QVFNWALDWVIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | Clone CH2E3.5 |
| 96 | PCPAPELLGGPSVFLFPPKPKDTLMISRTPEVTCVVVDVSHEDPEVX FXWYVDGVXVXXXXXXXPREEQYNSTYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | CH2A2 library (X denotes randomized amino acid position) |
| 97 | PCPAPELLGGPSVFLFPPKPKDTLMISRTPEVTCVVVDXXXXXXEVK FNWYVDGVEVHNAKTKPREEXYXXXYRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | CH2C library (X denotes randomized amino acid position) |
| 98 | PCPAPELLGGPSVFLFPPKPKDTLMISRTPEVTCVVVDVSXXXXXVK FNWYVDGVEVHNAKTKPXXXQXNSTXRVVSVLTVLHQDWLNGKEYKC KVSNKALPAPIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | CH2D library (X denotes randomized amino acid position) |
| 99 | PCPAPELLGGPSVFLFPPKPKDTLMISRTPEVTCVVVDVSHEDPXVX FXWYVDGVEVHNAKTKPREEQYNSTYRVVSVLTVLHQDWLNGKEYKC | CH2E3 library (X denotes randomized amino acid |

| SEQ ID NO: | Sequence | Description |
|---|---|---|
| | XVXNXALXXXIEKTISKAKGQPREPQVYTLPPSRDELTKNQVSLTCL VKGFYPSDIAVEWESNGQPENNYKTTPPVLDSDGSFFLYSKLTVDKS RWQQGNVFSCSVMHEALHNHYTQKSLSLSPGK | position) |
| 100 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPRXXXVXTLPPSRDELTKNQVSLTCL VKGFYPSDIAVEWESNGQPENNYKTTPPVLDSDGSFFLYSKLTVDKS RWQQGNVFSCSVMHEALHNHYXXXXLSLSPGK | CH3B library (X denotes randomized amino acid position) |
| 101 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPRFDYVTTLPPXXXEXXXXQVSLTCL VKGFYPSDIAVEWESNGQPENNYKTTPPVLDSDGSFFLYSKLTVDKS RWQQGNVFSCSVMHEALHNHYGFSDLSLSPGK | CH3B-patch1 library (X denotes randomized amino acid position) |
| 102 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPRFDYXTTLPPSRDELTKNQVSLTCL VKGFYPSDIAVEWESNGQPENNYKTTPPVLDSDGSFFLYSKLTVDKS RWQQGNVFSCSVMHEALXXHXGFSDLSLSPGK | CH3B-patch2 library (X denotes randomized amino acid position) |
| 103 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPRFDYVTTLXPSRDELTKNQVSLTCL VKGFYPSDIAVEWESNGQPENNYKTTPPVLDSDGSFFLYSKLTVDKS RWQQGNVFSCSVMHEALHNHYGFSDXSLXXXX | CH3B-patch3 library (X denotes randomized amino acid position) |
| 104 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGXPXFDYVTTLPPSRDELTKNQVSLTCL VXGFYPSDIAVEWESNGQPENNYKTTPPVLDSXGXFFLYSKLTVDKS RWQQGNVFSCSVMHEALHNHYGFSDLSLSPGK | CH3B-patch4 library (X denotes randomized amino acid position) |
| 105 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPRFDYVTTLPPSRDELTKNQVSLTCL VKGFYPSDIAVEWXSXXQPENNYKTTPPVLDSDGSFFLYSKLTVDKS RWQQXXXFSCSVMHEALHNHYGFSDLSLSPGK | CH3B-patch5 library (X denotes randomized amino acid position) |
| 106 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESXGXXXXXXYKTTPPVLDSDGSFFLYSKLTVXKS XWQQGXVFSCSVMHEALHNHYTQKSLSLSPGK | CH3C library (X denotes randomized amino acid position) |
| 107 | NSVIIVDKNGRLVYLVENPGGYVAYSKAATVTGKLVHANFGTKKDFE DLYTPVNGSIVIVRAGKITFAEKVANAESLNAIGVLIYMDQTKFPIV NAELSFFGHAHLGTGDPYTPGFPSFNHTQFPPSRSSGLPNIPVQTIS RAAAEKLFGNMEGDCPSDWKTDSTCRMVTSESKNVKLTVS | Human TfR apical domain |
| 108 | NSVIIVDKNGGLVYLVENPGGYVAYSKAATVTGKLVHANFGTKKDFE DLDSPVNGSIVIVRAGKITFAEKVANAESLNAIGVLIYMDQTKFPIV KADLSFFGHAHLGTGDPYTPGFPSFNHTQFPPSQSSGLPNIPVQTIS RAAAEKLFGNMEGDCPSDWKTDSTCKMVTSENKSVKLTVS | Cynomolgus TfR apical domain |
| 109 | SSGLPNIPVQTISRAAAEKLFGNMEGDCPSDWKTDSTCRMVTSESKN VKLTVSNDSAQNSVIIVDKNGRLVYLVENPGGYVAYSKAATVTGKLV HANFGTKKDFEDLYTPVNGSIVIVRAGKITFAEKVANAESLNAIGVL IYMDQTKFPIVNAELSGP | Loop-truncated human TfR apical domain displayed on phage |
| 110 | SSGLPNIPVQTISRAAAEKLFGNMEGDCPSDWKTDSTCKMVTSENKS VKLTVSNDSAQNSVIIVDKNGGLVYLVENPGGYVAYSKAATVTGKLV HANFGTKKDFEDLDSPVNGSIVIVRAGKITFAEKVANAESLNAIGVL IYMDQTKFPIVKADLSGP | Loop-truncated cynomolgus TfR apical domain displayed on phage |
| 111 | VPPXM | CH2D conserved sequence |
| 112 | SLTS | CH2D conserved sequence |
| 113 | WESXGXXXXXXYK | First portion CH3C register |
| 114 | TVXKSXWQQGXV | Second portion CH3C register |

-continued

| Informal Sequence Listing | | |
|---|---|---|
| SEQ ID NO: | Sequence | Description |
| 115 | YGTEW | CH3C conserved sequence |
| 116 | LGLVWVG | CH3C modified binding sequence |
| 117 | YGTVWSH | CH3C modified binding sequence |
| 118 | YGTEWSQ | CH3C modified binding sequence |
| 119 | VGTPWAL | CH3C modified binding sequence |
| 120 | YGTVWSK | CH3C modified binding sequence |
| 121 | LGHVWAV | CH3C modified binding sequence |
| 122 | MGHVWVG | CH3C modified binding sequence |
| 123 | LGLVGVF | CH3C modified binding sequence |
| 124 | YGTEWSS | CH3C modified binding sequence |
| 125 | YGTEWSN | CH3C modified binding sequence |
| 126 | LGHVWVG | CH3C modified binding sequence |
| 127 | LGHVWVA | CH3C modified binding sequence |
| 128 | LGPVWVH | CH3C modified binding sequence |
| 129 | LGHVWVD | CH3C modified binding sequence |
| 130 | LGHVWVN | CH3C modified binding sequence |
| 131 | AKSTWQQGW | CH3C modified binding sequence |
| 132 | SKSEWQQGY | CH3C modified binding sequence |
| 133 | EKSDWQQGH | CH3C modified binding sequence |
| 134 | LKSEWQQGW | CH3C modified binding sequence |
| 135 | SKSEWQQGF | CH3C modified binding sequence |
| 136 | PKSTWQQGW | CH3C modified binding sequence |
| 137 | DKSTWQQGW | CH3C modified binding sequence |
| 138 | TKSEWQQGF | CH3C modified binding sequence |
| 139 | SKSEWQQGW | CH3C modified binding sequence |

-continued

| SEQ ID NO: | Sequence | Description |
|---|---|---|
| 140 | FDYVT | CH3B modified binding sequence |
| 141 | FDMVT | CH3B modified binding sequence |
| 142 | FEYVT | CH3B modified binding sequence |
| 143 | FEMVT | CH3B modified binding sequence |
| 144 | FELVT | CH3B modified binding sequence |
| 145 | FEIVT | CH3B modified binding sequence |
| 146 | FDIVT | CH3B modified binding sequence |
| 147 | FGMVT | CH3B modified binding sequence |
| 148 | FADVT | CH3B modified binding sequence |
| 149 | FGLVT | CH3B modified binding sequence |
| 150 | IDYVT | CH3B modified binding sequence |
| 151 | FKDVT | CH3B modified binding sequence |
| 152 | FDLVT | CH3B modified binding sequence |
| 153 | FELVA | CH3B modified binding sequence |
| 154 | GHFD | CH3B modified binding sequence |
| 155 | GFYD | CH3B modified binding sequence |
| 156 | GFSD | CH3B modified binding sequence |
| 157 | GFFD | CH3B modified binding sequence |
| 158 | EFI | CH2A2 modified binding sequence |
| 159 | GFV | CH2A2 modified binding sequence |
| 160 | QFD | CH2A2 modified binding sequence |
| 161 | SFE | CH2A2 modified binding sequence |
| 162 | AFT | CH2A2 modified binding sequence |
| 163 | NFD | CH2A2 modified binding sequence |
| 164 | QFV | CH2A2 modified binding sequence |

| SEQ ID NO: | Sequence | Description |
|---|---|---|
| 165 | GFA | CH2A2 modified binding sequence |
| 166 | SFD | CH2A2 modified binding sequence |
| 167 | EFT | CH2A2 modified binding sequence |
| 168 | QFT | CH2A2 modified binding sequence |
| 169 | QFY | CH2A2 modified binding sequence |
| 170 | YFD | CH2A2 modified binding sequence |
| 171 | WFE | CH2A2 modified binding sequence |
| 172 | DVRYEWQL | CH2A2 modified binding sequence |
| 173 | PVSWEWYW | CH2A2 modified binding sequence |
| 174 | MVRREWHR | CH2A2 modified binding sequence |
| 175 | PVRWEWQW | CH2A2 modified binding sequence |
| 176 | PVRWEWQN | CH2A2 modified binding sequence |
| 177 | LVRREWHR | CH2A2 modified binding sequence |
| 178 | AVRWEWIR | CH2A2 modified binding sequence |
| 179 | EVAWEWFW | CH2A2 modified binding sequence |
| 180 | NVRVEWQY | CH2A2 modified binding sequence |
| 181 | EVRREWVR | CH2A2 modified binding sequence |
| 182 | LVRREWQR | CH2A2 modified binding sequence |
| 183 | DVRYEWYY | CH2A2 modified binding sequence |
| 184 | DVRYEWVR | CH2A2 modified binding sequence |
| 185 | NVRREWHR | CH2A2 modified binding sequence |
| 186 | FVGVAYDV | CH2A2 modified binding sequence |
| 187 | PQTPPW | CH2C modified binding sequence |
| 188 | PPSPPW | CH2C modified binding sequence |
| 189 | FRGPPW | CH2C modified binding sequence |

-continued

| Informal Sequence Listing | | |
|---|---|---|
| SEQ ID NO: | Sequence | Description |
| 190 | PQTVPW | CH2C modified binding sequence |
| 191 | PKMPPW | CH2C modified binding sequence |
| 192 | PPVPPW | CH2C modified binding sequence |
| 193 | PAFPPW | CH2C modified binding sequence |
| 194 | AIWPPW | CH2C modified binding sequence |
| 195 | PPVAPW | CH2C modified binding sequence |
| 196 | PQMPPQ | CH2C modified binding sequence |
| 197 | PQTAPW | CH2C modified binding sequence |
| 198 | PQTPPQ | CH2C modified binding sequence |
| 199 | PRVPPW | CH2C modified binding sequence |
| 200 | PSVPPW | CH2C modified binding sequence |
| 201 | MLWPVP | CH2C modified binding sequence |
| 202 | MEWPVT | CH2C modified binding sequence |
| 203 | DDLTFQ | CH2C modified binding sequence |
| 204 | AYGDPE | CH2C modified binding sequence |
| 205 | EYYTY | CH2C modified binding sequence |
| 206 | EYYSN | CH2C modified binding sequence |
| 207 | EYYHD | CH2C modified binding sequence |
| 208 | EYYQN | CH2C modified binding sequence |
| 209 | EYYSS | CH2C modified binding sequence |
| 210 | VYHRP | CH2C modified binding sequence |
| 211 | TYHNP | CH2C modified binding sequence |
| 212 | TYHHP | CH2C modified binding sequence |
| 213 | VYVTP | CH2C modified binding sequence |
| 214 | LYVTP | CH2C modified binding sequence |

-continued

Informal Sequence Listing

| SEQ ID NO: | Sequence | Description |
|---|---|---|
| 215 | WYDVP | CH2C modified binding sequence |
| 216 | VPPRM | CH2D modified binding sequence |
| 217 | VPPWM | CH2D modified binding sequence |
| 218 | DMWEY | CH2D modified binding sequence |
| 219 | DDWTW | CH2D modified binding sequence |
| 220 | DDWEW | CH2D modified binding sequence |
| 221 | LTSQHNSTV | CH2D modified binding sequence |
| 222 | WVKQLNSTW | CH2D modified binding sequence |
| 223 | WIAQPNSTW | CH2D modified binding sequence |
| 224 | WKLQLNSTW | CH2D modified binding sequence |
| 225 | WVWFY | CH2E3 modified binding sequence |
| 226 | VVGFR | CH2E3 modified binding sequence |
| 227 | IVGFR | CH2E3 modified binding sequence |
| 228 | AVGFE | CH2E3 modified binding sequence |
| 229 | SVVNIALWWS | CH2E3 modified binding sequence |
| 230 | RVSNSALTWK | CH2E3 modified binding sequence |
| 231 | RVSNSALSWR | CH2E3 modified binding sequence |
| 232 | RVSNSALRWR | CH2E3 modified binding sequence |
| 233 | QVFNWALDWV | CH2E3 modified binding sequence |
| 234 | EPKSCDKTHTCPPCP | Human IgG1 hinge amino acid sequence |
| 235 | MMDQARSAFSNLFGGEPLSYTRFSLARQVDGDNSHVEMKLAVDEEEN<br>ADNNTKANVTKPKRCSGSICYGTIAVIVFFLIGFMIGYLGYCKGVEP<br>KIECERLAGTESPVREEPGEDFPAARRLYWDDLKRKLSEKLDSTDFT<br>GTIKLLNENSYVPREAGSQKDENLALYVENQFREFKLSKVWRDQHFV<br>KIQVKDSAQNSVIIVDKNGRLVYLVENPGGYVAYSKAATVTGKLVHA<br>NFGTKKDFEDLYTPVNGSIVIVRAGKITFAEKVANAESLNAIGVLIY<br>MDQTKFPIVNAELSFFGHAHLGTGDPYTPGFPSFNHTQFPPSRSSGL<br>PNIPVQTISRAAAEKLFGNMEGDCPSDWKTDSTCRMVTSESKNVKLT<br>VSNVLKEIKILNIFGVIKGFVEPDHYVVVGAQRDAWGPGAAKSGVGT<br>ALLLKLAQMFSDMVLKDGFQPSRSIIFASWSAGDFGSVGATEWLEGY<br>LSSLHLKAFTYINLDKAVLGTSNFKVSASPLLYTLIEKTMQNVKHPV<br>TGQFLYQDSNWASKVEKLTLDNAAFPFLAYSGIPAVSFCFCEDTDYP<br>YLGTTMDTYKELIERIPELNKVARAAAEVAGQFVIKLTHDVELNLDY | Human transferrin receptor protein 1 (TFR1) |

| SEQ ID NO: | Sequence | Description |
|---|---|---|
| | ERYNSQLLSFVRDLNQYRADIKEMGLSLQWLYSARGDFFRATSRLTT<br>DFGNAEKTDRFVMKKLNDRVMRVEYHFLSPYVSPKESPFRHVFWGSG<br>SHTLPALLENLKLRKQNNGAFNETLFRNQLALATWTIQGAANALSGD<br>VWDIDNEF | |
| 236 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESYGIEWSSYKTTPPVLDSDGSFFLYSKLTVTKS<br>EWQQGFVFSCSVMHEALHNHYTQKSLSLSPGK | Clone CH3C.35.19 |
| 237 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESYGIEWSSYKTTPPVLDSDGSFFLYSKLTVTKE<br>EWQQGFVFSCSVMHEALHNHYTQKSLSLSPGK | Clone CH3C.35.20 |
| 238 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESYGIEWSSYKTTPPVLDSDGSFFLYSKLTVTKE<br>EWQQGFVFSCSVMHEALHNHYTQKSLSLSPGK | Clone CH3C.35.21 |
| 239 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESYGIEWSNYKTTPPVLDSDGSFFLYSKLTVTKS<br>EWQQGFVFSCSVMHEALHNHYTQKSLSLSPGK | Clone CH3C.35.22 |
| 240 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESYGIEWSNYKTTPPVLDSDGSFFLYSKLTVTKE<br>EWQQGFVFSCSVMHEALHNHYTQKSLSLSPGK | Clone CH3C.35.23 |
| 241 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESYGIEWSNYKTTPPVLDSDGSFFLYSKLTVTKE<br>EWQQGFVFSCSVMHEALHNHYTQKSLSLSPGK | Clone CH3C.35.24 |
| 242 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESLGHVWAVYKTTPPVLDSDGSFFLYSKLTVPKS<br>TWQQGWVFSCSVMHEALHNHYTQKSLSLSPGK | CH3C.18 variant |
| 243 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVLWESLGHVWAVYKTTPPVLDSDGSFFLYSKLTVPKS<br>TWQQGWVFSCSVMHEALHNHYTQKSLSLSPGK | CH3C.18 variant |
| 244 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVYWESLGHVWAVYKTTPPVLDSDGSFFLYSKLTVPKS<br>TWQQGWVFSCSVMHEALHNHYTQKSLSLSPGK | CH3C.18 variant |
| 245 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESLGHVWAVYQTTPPVLDSDGSFFLYSKLTVPKS<br>TWQQGWVFSCSVMHEALHNHYTQKSLSLSPGK | CH3C.18 variant |
| 246 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESLGHVWAVYFTTPPVLDSDGSFFLYSKLTVPKS<br>TWQQGWVFSCSVMHEALHNHYTQKSLSLSPGK | CH3C.18 variant |
| 247 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL | CH3C.18 variant |

| SEQ ID NO: | Sequence | Description |
|---|---|---|
| | VKGFYPSDIAVEWESLGHVWAVYHTTPPVLDSDGSFFLYSKLTVPKS TWQQGWVFSCSVMHEALHNHYTQKSLSLSPGK | |
| 248 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVLWESYGIEWSSYKTTPPVLDSDGSFFLYSKLTVTKS EWQQGFVFSCSVMHEALHNHYTQKSLSLSPGK | Clone CH3C.35.21.1 |
| 249 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVLWESYGIEWSSYRTTPPVLDSDGSFFLYSKLTVTKS EWQQGFVFSCSVMHEALHNHYTQKSLSLSPGK | Clone CH3C.35.21.2 |
| 250 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVLWESYGIEWSSYRTTPPVLDSDGSFFLYSKLTVTRE EWQQGFVFSCSVMHEALHNHYTQKSLSLSPGK | Clone CH3C.35.21.3 |
| 251 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVLWESYGIEWSSYRTTPPVLDSDGSFFLYSKLTVTGE EWQQGFVFSCSVMHEALHNHYTQKSLSLSPGK | Clone CH3C.35.21.4 |
| 252 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVLWESYGIEWSSYRTTPPVLDSDGSFFLYSKLTVTRE EWQQGFVFSCWVMHEALHNHYTQKSLSLSPGK | Clone CH3C.35.21.5 |
| 253 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVLWESYGIEWSSYRTTPPVLDSDGSFFLYSKLTVTKE EWQQGFVFSCWVMHEALHNHYTQKSLSLSPGK | Clone CH3C.35.21.6 |
| 254 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVLWESYGIEWSSYRTTPPVLDSDGSFFLYSKLTVTRE EWQQGFVFTCWVMHEALHNHYTQKSLSLSPGK | Clone CH3C.35.21.7 |
| 255 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVLWESYGIEWSSYRTTPPVLDSDGSFFLYSKLTVTRE EWQQGFVFTCGVMHEALHNHYTQKSLSLSPGK | Clone CH3C.35.21.8 |
| 256 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVLWESYGIEWSSYRTTPPVLDSDGSFFLYSKLTVTRE EWQQGFVFECWVMHEALHNHYTQKSLSLSPGK | Clone CH3C.35.21.9 |
| 257 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVLWESYGIEWSSYRTTPPVLDSDGSFFLYSKLTVTRE EWQQGFVFKCWVMHEALHNHYTQKSLSLSPGK | Clone CH3C.35.21.10 |
| 258 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVLWESYGIEWSSYRTTPPVLDSDGSFFLYSKLTVTPE EWQQGFVFKCWVMHEALHNHYTQKSLSLSPGK | Clone CH3C.35.21.11 |
| 259 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVWWESYGIEWSSYRTTPPVLDSDGSFFLYSKLTVTRE EWQQGFVFSCSVMHEALHNHYTQKSLSLSPGK | Clone CH3C.35.21.12 |

-continued

Informal Sequence Listing

| SEQ ID NO: | Sequence | Description |
|---|---|---|
| 260 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVWWESYGIEWSSYRTTPPVLDSDGSFFLYSKLTVTGE EWQQGFVFSCSVMHEALHNHYTQKSLSLSPGK | Clone CH3C.35.21.13 |
| 261 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVWWESYGIEWSSYRTTPPVLDSDGSFFLYSKLTVTRE EWQQGFVFTCWVMHEALHNHYTQKSLSLSPGK | Clone CH3C.35.21.14 |
| 262 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVWWESYGIEWSSYRTTPPVLDSDGSFFLYSKLTVTGE EWQQGFVFTCWVMHEALHNHYTQKSLSLSPGK | Clone CH3C.35.21.15 |
| 263 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVWWESYGIEWSSYRTTPPVLDSDGSFFLYSKLTVTRE EWQQGFVFTCGVMHEALHNHYTQKSLSLSPGK | Clone CH3C.35.21.16 |
| 264 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVLWESYGIEWSSYKTTPPVLDSDGSFFLYSKLTVTKE EWQQGFVFSCSVMHEALHNHYTQKSLSLSPGK | Clone CH3C.35.21.17 |
| 265 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVLWESYGIEWSSYRTTPPVLDSDGSFFLYSKLTVTKE EWQQGFVFSCSVMHEALHNHYTQKSLSLSPGK | Clone CH3C.35.21.18 |
| 266 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESFGIEWSSYKTTPPVLDSDGSFFLYSKLTVTKE EWQQGFVFSCSVMHEALHNHYTQKSLSLSPGK | Clone CH3C.35.20.1 |
| 267 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGIEWASYKTTPPVLDSDGSFFLYSKLTVTKE EWQQGFVFSCSVMHEALHNHYTQKSLSLSPGK | Clone CH3C.35.20.2 |
| 268 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGIEWVSYKTTPPVLDSDGSFFLYSKLTVTKE EWQQGFVFSCSVMHEALHNHYTQKSLSLSPGK | Clone CH3C.35.20.3 |
| 269 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGIEWSSYKTTPPVLDSDGSFFLYSKLTVSKE EWQQGFVFSCSVMHEALHNHYTQKSLSLSPGK | Clone CH3C.35.20.4 |
| 270 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESFGIEWASYKTTPPVLDSDGSFFLYSKLTVTKE EWQQGFVFSCSVMHEALHNHYTQKSLSLSPGK | Clone CH3C.35.20.5 |
| 271 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESFGIEWVSYKTTPPVLDSDGSFFLYSKLTVTKE EWQQGFVFSCSVMHEALHNHYTQKSLSLSPGK | Clone CH3C.35.20.6 |

Informal Sequence Listing

| SEQ ID NO: | Sequence | Description |
|---|---|---|
| 272 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESFGIEWSSYKTTPPVLDSDGSFFLYSKLTVTKE<br>EWQQGFVFSCSVMHEALHNHYTQKSLSLSPGK | Clone CH3C35.21.a.1 |
| 273 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESYGIEWASYKTTPPVLDSDGSFFLYSKLTVTKE<br>EWQQGFVFSCSVMHEALHNHYTQKSLSLSPGK | Clone CH3C.35.21.a.2 |
| 274 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESYGIEWVSYKTTPPVLDSDGSFFLYSKLTVTKE<br>EWQQGFVFSCSVMHEALHNHYTQKSLSLSPGK | Clone CH3C.35.21.a.3 |
| 275 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESYGIEWSSYKTTPPVLDSDGSFFLYSKLTVSKE<br>EWQQGFVFSCSVMHEALHNHYTQKSLSLSPGK | Clone CH3C.35.21.a.4 |
| 276 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESFGIEWASYKTTPPVLDSDGSFFLYSKLTVTKE<br>EWQQGFVFSCSVMHEALHNHYTQKSLSLSPGK | Clone CH3C.35.21.a.5 |
| 277 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESFGIEWVSYKTTPPVLDSDGSFFLYSKLTVTKE<br>EWQQGFVFSCSVMHEALHNHYTQKSLSLSPGK | Clone CH3C.35.21.a.6 |
| 278 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESFGIEWSNYKTTPPVLDSDGSFFLYSKLTVTKE<br>EWQQGFVFSCSVMHEALHNHYTQKSLSLSPGK | Clone CH3C.35.23.1 |
| 279 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESYGIEWANYKTTPPVLDSDGSFFLYSKLTVTKE<br>EWQQGFVFSCSVMHEALHNHYTQKSLSLSPGK | Clone CH3C.35.23.2 |
| 280 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESYGIEWVNYKTTPPVLDSDGSFFLYSKLTVTKE<br>EWQQGFVFSCSVMHEALHNHYTQKSLSLSPGK | Clone CH3C.35.23.3 |
| 281 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESYGIEWSNYKTTPPVLDSDGSFFLYSKLTVSKE<br>EWQQGFVFSCSVMHEALHNHYTQKSLSLSPGK | Clone CH3C.35.23.4 |
| 282 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESFGIEWANYKTTPPVLDSDGSFFLYSKLTVTKE<br>EWQQGFVFSCSVMHEALHNHYTQKSLSLSPGK | Clone CH3C.35.23.5 |
| 283 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESFGIEWVNYKTTPPVLDSDGSFFLYSKLTVTKE<br>EWQQGFVFSCSVMHEALHNHYTQKSLSLSPGK | Clone CH3C.35.23.6 |
| 284 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC | Clone CH3C.35.24.1 |

| SEQ ID NO: | Sequence | Description |
|---|---|---|
| | KVSNKALPAPIEKTISKAKGQPREPQVYTLPPSRDELTKNQVSLTCL<br>VKGFYPSDIAVWWESFGIEWSNYKTTPPVLDSDGSFFLYSKLTVTKE<br>EWQQGFVFSCSVMHEALHNHYTQKSLSLSPGK | |
| 285 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESYGIEWANYKTTPPVLDSDGSFFLYSKLTVTKE<br>EWQQGFVFSCSVMHEALHNHYTQKSLSLSPGK | Clone CH3C.35.24.2 |
| 286 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESYGIEWVNYKTTPPVLDSDGSFFLYSKLTVTKE<br>EWQQGFVFSCSVMHEALHNHYTQKSLSLSPGK | Clone CH3C.35.24.3 |
| 287 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESFGIEWSNYKTTPPVLDSDGSFFLYSKLTVSKE<br>EWQQGFVFSCSVMHEALHNHYTQKSLSLSPGK | Clone CH3C.35.24.4 |
| 288 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESFGIEWANYKTTPPVLDSDGSFFLYSKLTVTKE<br>EWQQGFVFSCSVMHEALHNHYTQKSLSLSPGK | Clone CH3C.35.24.5 |
| 289 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVWWESFGIEWVNYKTTPPVLDSDGSFFLYSKLTVTKE<br>EWQQGFVFSCSVMHEALHNHYTQKSLSLSPGK | Clone CH3C.35.24.6 |
| 290 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVLWESFGIEWSSYKTTPPVLDSDGSFFLYSKLTVTKE<br>EWQQGFVFSCSVMHEALHNHYTQKSLSLSPGK | Clone CH3C.35.21.17.1 |
| 291 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVLWESYGIEWASYKTTPPVLDSDGSFFLYSKLTVTKE<br>EWQQGFVFSCSVMHEALHNHYTQKSLSLSPGK | Clone CH3C.35.21.17.2 |
| 292 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVLWESYGIEWVSYKTTPPVLDSDGSFFLYSKLTVTKE<br>EWQQGFVFSCSVMHEALHNHYTQKSLSLSPGK | Clone CH3C.35.21.17.3 |
| 293 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVLWESYGIEWSSYKTTPPVLDSDGSFFLYSKLTVSKE<br>EWQQGFVFSCSVMHEALHNHYTQKSLSLSPGK | Clone CH3C.35.21.17.4 |
| 294 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVLWESFGIEWASYKTTPPVLDSDGSFFLYSKLTVTKE<br>EWQQGFVFSCSVMHEALHNHYTQKSLSLSPGK | Clone CH3C.35.21.17.5 |
| 295 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVLWESFGIEWVSYKTTPPVLDSDGSFFLYSKLTVTKE<br>EWQQGFVFSCSVMHEALHNHYTQKSLSLSPGK | Clone CH3C.35.21.17.6 |

| SEQ ID NO: | Sequence | Description |
|---|---|---|
| 296 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGIEWSNYKTTPPVLDSDGSFFLYSKLTVTKS EWQQGFVFSCSVMHEALHNHYTQKSLSLSPGK | Clone CH3C.35.N390 |
| 297 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVWWESLGHVWVNQKTTPPVLDSDGSFFLYSKLTVPKS TWQQGWVFSCSVMHEALHNHYTQKSLSLSPGK | Clone CH3C.35.16 |
| 298 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESLGHVWVNQQTTPPVLDSDGSFFLYSKLTVPKS TWQQGWVFSCSVMHEALHNHYTQKSLSLSPGK | Clone CH3C.35.17 |
| 299 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVWWESLGHVWVNQQTTPPVLDSDGSFFLYSKLTVPKS TWQQGWVFSCSVMHEALHNHYTQKSLSLSPGK | Clone CH3C.35.18 |
| 300 | MMDQARSAFSNLFGGEPLSYTRFSLARQVDGDNSHVEMKLGVDEEEN TDNNTKANGTKPKRCGGNICYGTIAVIIFFLIGFMIGYLGYCKGVEP KIECERLAGTESPAREEPEEDFPAAPRLYWDDLKRKLSEKLDTTDFT STIKLLNENLYVPREAGSQKDENLALYIENQFREFKLSKVWRDQHFV KIQVKDSAQNSVIIVDKNGGLVYLVENPGGYVAYSKAATVTGKLVHA NFGTKKDFEDLDSPVNGSIVIVRAGKITFAEKVANAESLNAIGVLIY MDQTKFPIVKADLSFFGHAHLGTDPYTPGFPSFNHTQFPPSQSSGL PNIPVQTISRAAAEKLFGNMEGDCPSDWKTDSTCKMVTSENKSVKLT VSNVLKETKILNIFGVIKGFVEPDHYVVVGAQRDAWGPGAAKSSVGT ALLLKLAQMFSDMVLKDGFQPSRSIIFASWSAGDFGSVGATEWLEGY LSSLHLKAFTYINLDKAVLGTSNFKVSASPLLYTLIEKTMQDVKHPV TGRSLYQDSNWASKVEKLTLDNAAFPFLAYSGIPAVSFCFCEDTDYP YLGTTMDTYKELVERIPELNKVARAAAEVAGQFVIKLTHDTELNLDY ERYNSQLLLFLRDLNQYRADVKEMGLSLQWLYSARGDFFRATSRLTT DFRNAEKRDKFVMKKLNDRVMRVEYYFLSPYVSPKESPFRHVFWGSG SHTLSALLESLKLRRQNNSAFNETLFRNQLALATWTIQGAANALSGD VWDIDNEF | Cyno TfR |
| 301 | MGWSCIILFLVATATGAYAGTSSGLPNIPVQTISRAAAEKLFGNMEG DCPSDWKTDSTCRMVTSESKNVKLTVSNDSAQNSVIIVDKNGRLVYL VENPGGYVAYSKAATVTGKLVHANFGTKKDFEDLYTPVNGSIVIVRA GKITFAEKVANAESLNAIGVLIYMDQTKFPIVNAELSASHHHHHH | His-tagged permutated TfR apical domain |
| 302 | METDTLLLWVLLLWVPGSTGDKTHTCPPCPAPEAAGGPSVFLFPPKP KDTLYITREPEVTCVVVDVSHEDPEVKFNWYVDGVEVHNAKTKPREE QYNSTYRVVSVLTVLHQDWLNGKEYKCKVSNKALGAPIEKTISKAKG QPREPQVYTLPPSRDELTKNQVSLTCLVKGFYPSDIAVEWESLGHVW AVYKTTPPVLDSDGSFFLYSKLTVPKSTWQQGWVFSCSVMHEALHNH YTQKSLSLSPGK | Expressed CH3C.18 Fc sequence |
| 303 | EWESFGTEWSS | CH3C modified binding sequence |
| 304 | EWESYGTEWAS | CH3C modified binding sequence |
| 305 | EWESYGTEWVS | CH3C modified binding sequence |
| 306 | EWESYGTEWSS | CH3C modified binding sequence |
| 307 | EWESFGTEWAS | CH3C modified binding sequence |
| 308 | EWESFGTEWVS | CH3C modified binding sequence |
| 309 | WWESFGTEWSS | CH3C modified binding sequence |

-continued

| SEQ ID NO: | Sequence | Description |
|---|---|---|
| 310 | WWESYGTEWAS | CH3C modified binding sequence |
| 311 | WWESYGTEWVS | CH3C modified binding sequence |
| 312 | WWESYGTEWSS | CH3C modified binding sequence |
| 313 | WWESFGTEWAS | CH3C modified binding sequence |
| 314 | WWESFGTEWVS | CH3C modified binding sequence |
| 315 | EWESFGTEWSN | CH3C modified binding sequence |
| 316 | EWESYGTEWAN | CH3C modified binding sequence |
| 317 | EWESYGTEWVN | CH3C modified binding sequence |
| 318 | EWESYGTEWSN | CH3C modified binding sequence |
| 319 | EWESFGTEWAN | CH3C modified binding sequence |
| 320 | EWESFGTEWVN | CH3C modified binding sequence |
| 321 | WWESFGTEWSN | CH3C modified binding sequence |
| 322 | WWESYGTEWAN | CH3C modified binding sequence |
| 323 | WWESYGTEWVN | CH3C modified binding sequence |
| 324 | WWESYGTEWSN | CH3C modified binding sequence |
| 325 | WWESFGTEWAN | CH3C modified binding sequence |
| 326 | WWESFGTEWVN | CH3C modified binding sequence |
| 327 | LWESFGTEWSS | CH3C modified binding sequence |
| 328 | LWESYGTEWAS | CH3C modified binding sequence |
| 329 | LWESYGTEWVS | CH3C modified binding sequence |
| 330 | LWESYGTEWSS | CH3C modified binding sequence |
| 331 | LWESFGTEWAS | CH3C modified binding sequence |
| 332 | LWESFGTEWVS | CH3C modified binding sequence |
| 333 | WWESLGHVWAV | CH3C modified binding sequence |
| 334 | EWESLGHVWAV | CH3C modified binding sequence |

| SEQ ID NO: | Sequence | Description |
|---|---|---|
| 335 | LWESLGHVWAV | CH3C modified binding sequence |
| 336 | YWESLGHVWAV | CH3C modified binding sequence |
| 337 | EWESLGLVWVF | CH3C modified binding sequence |
| 338 | WWESLGHVWVN | CH3C modified binding sequence |
| 339 | EWESLGHVWVN | CH3C modified binding sequence |
| 340 | TKEEWQQGF | CH3C modified binding sequence |
| 341 | SKEEWQQGF | CH3C modified binding sequence |
| 342 | PKTSWQQGW | CH3C modified binding sequence |
| 343 | TREEWQQGF | CH3C modified binding sequence |
| 344 | TPEEWQQGF | CH3C modified binding sequence |
| 345 | TGEEWQQGF | CH3C modified binding sequence |
| 346 | TVXKXXWQQGXV | Second portion CH3C register |
| 347 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLTCL VKGFYPSDIAVEWESYGIEWSSYKTTPPVLDSDGSFFLYSKLTVTKE EWQQGFVFSCSVMHEALHNHYTQKSLSLSPGK | Clone CH3C.35.8 (Clone CH3C.35.20 with YTE and LALAPG mutations) |
| 348 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLTCL VKGFYPSDIAVEWESFGIEWSSYKTTPPVLDSDGSFFLYSKLTVTKE EWQQGFVFSCSVMHEALHNHYTQKSLSLSPGK | Clone CH3C.35.9 (Clone CH3C.35.21 with YTE and LALAPG mutations) |
| 349 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGIEWSSYKTTPPVLDSDGSFFLYSKLTVTKE EWQQGFVFSCSVMHEALHNHYTQKSLSLSPGK | Clone CH3C.35.20.1 with knob mutation |
| 350 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGIEWSSYKTTPPVLDSDGSFFLYSKLTVTKE EWQQGFVFSCSVMHEALHNHYTQKSLSLSPGK | Clone CH3C.35.20.1 with knob and LALA mutations |
| 351 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESFGIEWSSYKTTPPVLDSDGSFFLYSKLTVTKE EWQQGFVFSCSVMHEALHNHYTQKSLSLSPGK | Clone CH3C.35.20.1 with knob and LALAPG mutations |
| 352 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGIEWSSYKTTPPVLDSDGSFFLYSKLTVTKE EWQQGFVFSCSVMHEALHNHYTQKSLSLSPGK | Clone CH3C.35.20.1 with knob and YTE mutations |

Informal Sequence Listing

| SEQ ID NO: | Sequence | Description |
|---|---|---|
| 353 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGIEWSSYKTTPPVLDSDGSFFLYSKLTVTKE EWQQGFVFSCSVMHEALHNHYTQKSLSLSPGK | Clone CH3C.35.20.1 with knob, LALA, and YTE mutations |
| 354 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESFGIEWSSYKTTPPVLDSDGSFFLYSKLTVTKE EWQQGFVFSCSVMHEALHNHYTQKSLSLSPGK | Clone CH3C.35.20.1 with knob, LALAPG, and YTE mutations |
| 355 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSSYKTTPPVLDSDGSFFLVSKLTVTKE EWQQGFVFSCSVMHEALHNHYTQKSLSLSPGK | Clone CH3C.35.20.1 with hole mutations |
| 356 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSSYKTTPPVLDSDGSFFLVSKLTVTKE EWQQGFVFSCSVMHEALHNHYTQKSLSLSPGK | Clone CH3C.35.20.1 with hole and LALA mutations |
| 357 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESFGIEWSSYKTTPPVLDSDGSFFLVSKLTVTKE EWQQGFVFSCSVMHEALHNHYTQKSLSLSPGK | Clone CH3C.35.20.1 with hole and LALAPG mutations |
| 358 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSSYKTTPPVLDSDGSFFLVSKLTVTKE EWQQGFVFSCSVMHEALHNHYTQKSLSLSPGK | Clone CH3C.35.20.1 with hole and YTE mutations |
| 359 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSSYKTTPPVLDSDGSFFLVSKLTVTKE EWQQGFVFSCSVMHEALHNHYTQKSLSLSPGK | Clone CH3C.35.20.1 with hole, LALA, and YTE mutations |
| 360 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESFGIEWSSYKTTPPVLDSDGSFFLVSKLTVTKE EWQQGFVFSCSVMHEALHNHYTQKSLSLSPGK | Clone CH3C.35.20.1 with hole, LALAPG, and YTE mutations |
| 361 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGIEWANYKTTPPVLDSDGSFFLYSKLTVTKE EWQQGFVFSCSVMHEALHNHYTQKSLSLSPGK | Clone CH3C.35.23.2 with knob mutation |
| 362 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGTEWANYKTTPPVLDSDGSFFLYSKLTVTKE EWQQGFVFSCSVMHEALHNHYTQKSLSLSPGK | Clone CH3C.35.23.2 with knob and LALA mutations |
| 363 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESYGTEWANYKTTPPVLDSDGSFFLYSKLTVTKE EWQQGFVFSCSVMHEALHNHYTQKSLSLSPGK | Clone CH3C.35.23.2 with knob and LALAPG mutations |
| 364 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGIEWANYKTTPPVLDSDGSFFLYSKLTVTKE EWQQGFVFSCSVMHEALHNHYTQKSLSLSPGK | Clone CH3C.35.23.2 with knob and YTE mutations |
| 365 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC | Clone CH3C.35.23.2 with knob, LALA, and YTE |

-continued

Informal Sequence Listing

| SEQ ID NO: | Sequence | Description |
|---|---|---|
| | KVSNKALPAPIEKTISKAKGQPREPQVYTLPPSRDELTKNQVSLWCL VKGFYPSDIAVEWESYGIEWANYKTTPPVLDSDGSFFLYSKLTVTKE EWQQGFVFSCSVMHEALHNHYTQKSLSLSPGK | mutations |
| 366 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESYGIEWANYKTTPPVLDSDGSFFLYSKLTVTKE EWQQGFVFSCSVMHEALHNHYTQKSLSLSPGK | Clone CH3C.35.23.2 with knob, LALAPG, and YTE mutations |
| 367 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWANYKTTPPVLDSDGSFFLVSKLTVTKE EWQQGFVFSCSVMHEALHNHYTQKSLSLSPGK | Clone CH3C.35.23.2 with hole mutations |
| 368 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWANYKTTPPVLDSDGSFFLVSKLTVTKE EWQQGFVFSCSVMHEALHNHYTQKSLSLSPGK | Clone CH3C.35.23.2 with hole and LALA mutations |
| 369 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESYGIEWANYKTTPPVLDSDGSFFLVSKLTVTKE EWQQGFVFSCSVMHEALHNHYTQKSLSLSPGK | Clone CH3C.35.23.2 with hole and LALAPG mutations |
| 370 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWANYKTTPPVLDSDGSFFLVSKLTVTKE EWQQGFVFSCSVMHEALHNHYTQKSLSLSPGK | Clone CH3C.35.23.2 with hole and YTE mutations |
| 371 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWANYKTTPPVLDSDGSFFLVSKLTVTKE EWQQGFVFSCSVMHEALHNHYTQKSLSLSPGK | Clone CH3C.35.23.2 with hole, LALA, and YTE mutations |
| 372 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESYGIEWANYKTTPPVLDSDGSFFLVSKLTVTKE EWQQGFVFSCSVMHEALHNHYTQKSLSLSPGK | Clone CH3C.35.23.2 with hole, LALAPG, and YTE mutations |
| 373 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGIEWVNYKTTPPVLDSDGSFFLYSKLTVTKE EWQQGFVFSCSVMHEALHNHYTQKSLSLSPGK | Clone CH3C.35.23.3 with knob mutation |
| 374 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGTEWVNYKTTPPVLDSDGSFFLYSKLTVTKE EWQQGFVFSCSVMHEALHNHYTQKSLSLSPGK | Clone CH3C.35.23.3 with knob and LALA mutations |
| 375 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESYGTEWVNYKTTPPVLDSDGSFFLYSKLTVTKE EWQQGFVFSCSVMHEALHNHYTQKSLSLSPGK | Clone CH3C.35.23.3 with knob and LALAPG mutations |
| 376 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGIEWVNYKTTPPVLDSDGSFFLYSKLTVTKE EWQQGFVFSCSVMHEALHNHYTQKSLSLSPGK | Clone CH3C.35.23.3 with knob and YTE mutations |

US 11,795,232 B2

171                                                                                                              172
-continued

| Informal Sequence Listing | | |
|---|---|---|
| SEQ ID NO: | Sequence | Description |
| 377 | PCPAPEAAGGPSVFLFPPKPKDTLYITREPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLWCL<br>VKGFYPSDIAVEWESYGIEWVNYKTTPPVLDSDGSFFLYSKLTVTKE<br>EWQQGFVFSCSVMHEALHNHYTQKSLSLSPGK | Clone CH3C.35.23.3 with knob, LALA, and YTE mutations |
| 378 | PCPAPEAAGGPSVFLFPPKPKDTLYITREPEVTCVVVDVSHEDPEVK<br>FNWYVDGVEVHNAKTKPREEQYNSTYRVVSVLTVLHQDWLNGKEYKC<br>KVSNKALGAPIEKTISKAKGQPREPQVYTLPPSRDELTKNQVSLWCL<br>VKGFYPSDIAVEWESYGIEWVNYKTTPPVLDSDGSFFLYSKLTVTKE<br>EWQQGFVFSCSVMHEALHNHYTQKSLSLSPGK | Clone CH3C.35.23.3 with knob, LALAPG, and YTE mutations |
| 379 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLSCA<br>VKGFYPSDIAVEWESYGIEWVNYKTTPPVLDSDGSFFLVSKLTVTKE<br>EWQQGFVFSCSVMHEALHNHYTQKSLSLSPGK | Clone CH3C.35.23.3 with hole mutations |
| 380 | PCPAPEAAGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLSCA<br>VKGFYPSDIAVEWESYGIEWVNYKTTPPVLDSDGSFFLVSKLTVTKE<br>EWQQGFVFSCSVMHEALHNHYTQKSLSLSPGK | Clone CH3C.35.23.3 with hole and LALA mutations |
| 381 | PCPAPEAAGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALGAPIEKTISKAKGQPREPQVYTLPPSRDELTKNQVSLSCA<br>VKGFYPSDIAVEWESYGIEWVNYKTTPPVLDSDGSFFLVSKLTVTKE<br>EWQQGFVFSCSVMHEALHNHYTQKSLSLSPGK | Clone CH3C.35.23.3 with hole and LALAPG mutations |
| 382 | PCPAPELLGGPSVFLFPPKPKDTLYITREPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLSCA<br>VKGFYPSDIAVEWESYGIEWVNYKTTPPVLDSDGSFFLVSKLTVTKE<br>EWQQGFVFSCSVMHEALHNHYTQKSLSLSPGK | Clone CH3C.35.23.3 with hole and YTE mutations |
| 383 | PCPAPEAAGGPSVFLFPPKPKDTLYITREPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLSCA<br>VKGFYPSDIAVEWESYGIEWVNYKTTPPVLDSDGSFFLVSKLTVTKE<br>EWQQGFVFSCSVMHEALHNHYTQKSLSLSPGK | Clone CH3C.35.23.3 with hole, LALA, and YTE mutations |
| 384 | PCPAPEAAGGPSVFLFPPKPKDTLYITREPEVTCVVVDVSHEDPEVK<br>FNWYVDGVEVHNAKTKPREEQYNSTYRVVSVLTVLHQDWLNGKEYKC<br>KVSNKALGAPIEKTISKAKGQPREPQVYTLPPSRDELTKNQVSLSCA<br>VKGFYPSDIAVEWESYGIEWVNYKTTPPVLDSDGSFFLVSKLTVTKE<br>EWQQGFVFSCSVMHEALHNHYTQKSLSLSPGK | Clone CH3C.35.23.3 with hole, LALAPG, and YTE mutations |
| 385 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLWCL<br>VKGFYPSDIAVEWESYGIEWSNYKTTPPVLDSDGSFFLYSKLTVSKE<br>EWQQGFVFSCSVMHEALHNHYTQKSLSLSPGK | Clone CH3C.35.23.4 with knob mutation |
| 386 | PCPAPEAAGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLWCL<br>VKGFYPSDIAVEWESYGTEWSNYKTTPPVLDSDGSFFLYSKLTVSKE<br>EWQQGFVFSCSVMHEALHNHYTQKSLSLSPGK | Clone CH3C.35.23.4 with knob and LALA mutations |
| 387 | PCPAPEAAGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALGAPIEKTISKAKGQPREPQVYTLPPSRDELTKNQVSLWCL<br>VKGFYPSDIAVEWESYGTEWSNYKTTPPVLDSDGSFFLYSKLTVSKE<br>EWQQGFVFSCSVMHEALHNHYTQKSLSLSPGK | Clone CH3C.35.23.4 with knob and LALAPG mutations |
| 388 | PCPAPELLGGPSVFLFPPKPKDTLYITREPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLWCL<br>VKGFYPSDIAVEWESYGIEWSNYKTTPPVLDSDGSFFLYSKLTVSKE<br>EWQQGFVFSCSVMHEALHNHYTQKSLSLSPGK | Clone CH3C.35.23.4 with knob and YTE mutations |
| 389 | PCPAPEAAGGPSVFLFPPKPKDTLYITREPEVTCVVVDVSHEDPEVK<br>FNWYVDGVEVHNAKTKPREEQYNSTYRVVSVLTVLHQDWLNGKEYKC | Clone CH3C.35.23.4 with knob, LALA, and YTE |

Informal Sequence Listing

| SEQ ID NO: | Sequence | Description |
|---|---|---|
| | KVSNKALPAPIEKTISKAKGQPREPQVYTLPPSRDELTKNQVSLWCL VKGFYPSDIAVEWESYGIEWSNYKTTPPVLDSDGSFFLYSKLTVSKE EWQQGFVFSCSVMHEALHNHYTQKSLSLSPGK | mutations |
| 390 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESYGIEWSNYKTTPPVLDSDGSFFLYSKLTVSKE EWQQGFVFSCSVMHEALHNHYTQKSLSLSPGK | Clone CH3C.35.23.4 with knob, LALAPG, and YTE mutations |
| 391 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGTEWSNYKTTPPVLDSDGSFFLVSKLTVSKE EWQQGFVFSCSVMHEALHNHYTQKSLSLSPGK | Clone CH3C.35.23.4 with hole mutations |
| 392 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWSNYKTTPPVLDSDGSFFLYSKLTVSKE EWQQGFVFSCSVMHEALHNHYTQKSLSLSPGK | Clone CH3C.35.23.4 with hole and LALA mutations |
| 393 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESYGIEWSNYKTTPPVLDSDGSFFLYSKLTVSKE EWQQGFVFSCSVMHEALHNHYTQKSLSLSPGK | Clone CH3C.35.23.4 with hole and LALAPG mutations |
| 394 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGTEWSNYKTTPPVLDSDGSFFLVSKLTVSKE EWQQGFVFSCSVMHEALHNHYTQKSLSLSPGK | Clone CH3C.35.23.4 with hole and YTE mutations |
| 395 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGTEWSNYKTTPPVLDSDGSFFLVSKLTVSKE EWQQGFVFSCSVMHEALHNHYTQKSLSLSPGK | Clone CH3C.35.23.4 with hole, LALA, and YTE mutations |
| 396 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESYGTEWSNYKTTPPVLDSDGSFFLVSKLTVSKE EWQQGFVFSCSVMHEALHNHYTQKSLSLSPGK | Clone CH3C.35.23.4 with hole, LALAPG, and YTE mutations |
| 397 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVLWESYGIEWASYKTTPPVLDSDGSFFLYSKLTVTKE EWQQGFVFSCSVMHEALHNHYTQKSLSLSPGK | Clone CH3C.35.21.17.2 with knob mutation |
| 398 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVLWESYGTEWASYKTTPPVLDSDGSFFLYSKLTVTKE EWQQGFVFSCSVMHEALHNHYTQKSLSLSPGK | Clone CH3C.35.21.17.2 with knob and LALA mutations |
| 399 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVLWESYGTEWASYKTTPPVLDSDGSFFLYSKLTVTKE EWQQGFVFSCSVMHEALHNHYTQKSLSLSPGK | Clone CH3C.35.21.17.2 with knob and LALAPG mutations |
| 400 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVLWESYGIEWASYKTTPPVLDSDGSFFLYSKLTVTKE EWQQGFVFSCSVMHEALHNHYTQKSLSLSPGK | Clone CH3C.35.21.17.2 with knob and YTE mutations |

-continued

Informal Sequence Listing

| SEQ ID NO: | Sequence | Description |
|---|---|---|
| 401 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVLWESYGIEWASYKTTPPVLDSDGSFFLYSKLTVTKE EWQQGFVFSCSVMHEALHNHYTQKSLSLSPGK | Clone CH3C.35.21.17.2 with knob, LALA, and YTE mutations |
| 402 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVLWESYGIEWASYKTTPPVLDSDGSFFLYSKLTVTKE EWQQGFVFSCSVMHEALHNHYTQKSLSLSPGK | Clone CH3C.35.21.17.2 with knob, LALAPG, and YTE mutations |
| 403 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVLWESYGTEWASYKTTPPVLDSDGSFFLVSKLTVTKE EWQQGFVFSCSVMHEALHNHYTQKSLSLSPGK | Clone CH3C.35.21.17.2 with hole mutations |
| 404 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVLWESYGIEWASYKTTPPVLDSDGSFFLVSKLTVTKE EWQQGFVFSCSVMHEALHNHYTQKSLSLSPGK | Clone CH3C.35.21.17.2 with hole and LALA mutations |
| 405 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVLWESYGIEWASYKTTPPVLDSDGSFFLVSKLTVTKE EWQQGFVFSCSVMHEALHNHYTQKSLSLSPGK | Clone CH3C.35.21.17.2 with hole and LALAPG mutations |
| 406 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVLWESYGTEWASYKTTPPVLDSDGSFFLVSKLTVTKE EWQQGFVFSCSVMHEALHNHYTQKSLSLSPGK | Clone CH3C.35.21.17.2 with hole and YTE mutations |
| 407 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVLWESYGTEWASYKTTPPVLDSDGSFFLVSKLTVTKE EWQQGFVFSCSVMHEALHNHYTQKSLSLSPGK | Clone CH3C.35.21.17.2 with hole, LALA, and YTE mutations |
| 408 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVLWESYGTEWASYKTTPPVLDSDGSFFLVSKLTVTKE EWQQGFVFSCSVMHEALHNHYTQKSLSLSPGK | Clone CH3C.35.21.17.2 with hole, LALAPG, and YTE mutations |
| 409 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGIEWSNYKTTPPVLDSDGSFFLYSKLTVTKE EWQQGFVFSCSVMHEALHNHYTQKSLSLSPGK | Clone CH3C.35.23 with knob mutation |
| 410 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGTEWSNYKTTPPVLDSDGSFFLYSKLTVTKE EWQQGFVFSCSVMHEALHNHYTQKSLSLSPGK | Clone CH3C.35.23 with knob and LALA mutations |
| 411 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESYGTEWSNYKTTPPVLDSDGSFFLYSKLTVTKE EWQQGFVFSCSVMHEALHNHYTQKSLSLSPGK | Clone CH3C.35.23 with knob and LALAPG mutations |
| 412 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGIEWSNYKTTPPVLDSDGSFFLYSKLTVTKE EWQQGFVFSCSVMHEALHNHYTQKSLSLSPGK | Clone CH3C.35.23 with knob and YTE mutations |
| 413 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC | Clone CH3C.35.23 with knob, LALA, and YTE |

-continued

| SEQ ID NO: | Sequence | Description |
|---|---|---|
| | KVSNKALPAPIEKTISKAKGQPREPQVYTLPPSRDELTKNQVSLWCL VKGFYPSDIAVEWESYGIEWSNYKTTPPVLDSDGSFFLYSKLTVTKE EWQQGFVFSCSVMHEALHNHYTQKSLSLSPGK | mutations |
| 414 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESYGIEWSNYKTTPPVLDSDGSFFLYSKLTVTKE EWQQGFVFSCSVMHEALHNHYTQKSLSLSPGK | Clone CH3C.35.23 with knob, LALAPG, and YTE mutations |
| 415 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGTEWSNYKTTPPVLDSDGSFFLVSKLTVTKE EWQQGFVFSCSVMHEALHNHYTQKSLSLSPGK | Clone CH3C.35.23 with hole mutations |
| 416 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGTEWSNYKTTPPVLDSDGSFFLVSKLTVTKE EWQQGFVFSCSVMHEALHNHYTQKSLSLSPGK | Clone CH3C.35.23 with hole and LALA mutations |
| 417 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESYGTEWSNYKTTPPVLDSDGSFFLVSKLTVTKE EWQQGFVFSCSVMHEALHNHYTQKSLSLSPGK | Clone CH3C.35.23 with hole and LALAPG mutations |
| 418 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGTEWSNYKTTPPVLDSDGSFFLVSKLTVTKE EWQQGFVFSCSVMHEALHNHYTQKSLSLSPGK | Clone CH3C.35.23 with hole and YTE mutations |
| 419 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGTEWSNYKTTPPVLDSDGSFFLVSKLTVTKE EWQQGFVFSCSVMHEALHNHYTQKSLSLSPGK | Clone CH3C.35.23 with hole, LALA, and YTE mutations |
| 420 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESYGTEWSNYKTTPPVLDSDGSFFLVSKLTVTKE EWQQGFVFSCSVMHEALHNHYTQKSLSLSPGK | Clone CH3C.35.23 with hole, LALAPG, and YTE mutations |
| 421 | METDTLLLWVLLLWVPGSTGDKTHTCPPCPAPEAAGGPSVFLFPPKP KDTLYITREPEVTCVVVDVSHEDPEVKFNWYVDGVEVHNAKTKPREE QYNSTYRVVSVLTVLHQDWLNGKEYKCKVSNKALGAPIEKTISKAKG QPREPQVYTLPPSRDELTKNQVSLTCLVKGFYPSDIAVEWESYGTEW SSYKTTPPVLDSDGSFFLYSKLTVTKSEWQQGFWSCSVMHEALHNHY TQKSLSLSPGK | Expressed CH3C.35 Fc sequence |
| 422 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESWGFVWSTYKTTPPVLDSDGSFFLYSKLTVPKS NWQQGFVFSCSVMHEALHNHYTQKSLSLSPGK | Clone CH3C.18.3.4-1 (CH3C.3.4-1) |
| 423 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESWGHVWSTYKTTPPVLDSDGSFFLYSKLTVPKS NWQQGYVFSCSVMHEALHNHYTQKSLSLSPGK | Clone CH3C.18.3.4-19 (CH3C.3.4-19) |
| 424 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESLGHVWVEQKTTPPVLDSDGSFFLYSKLTVPKS TWQQGWVFSCSVMHEALHNHYTQKSLSLSPGK | Clone CH3C.18.3.2-3 (CH3C.3.2-3) |
| 425 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL | Clone CH3C.18.3.2-14 (CH3C.3.2-14) |

-continued

Informal Sequence Listing

| SEQ ID NO: | Sequence | Description |
|---|---|---|
| | VKGFYPSDIAVEWESLGHVWVGVKTTPPVLDSDGSFFLYSKLTVPKS<br>TWQQGWVFSCSVMHEALHNHYTQKSLSLSPGK | |
| 426 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESLGHVWVHTKTTPPVLDSDGSFFLYSKLTVPKS<br>TWQQGWVFSCSVMHEALHNHYTQKSLSLSPGK | Clone CH3C.18.3.2-24<br>(CH3C.3.2-24) |
| 427 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESWGTVWGTYKTTPPVLDSDGSFFLYSKLTVPKS<br>NWQQGYVFSCSVMHEALHNHYTQKSLSLSPGK | Clone CH3C.18.3.4-26<br>(CH3C.3.4-26) |
| 428 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESLGHVWVGTKTTPPVLDSDGSFFLYSKLTVPKS<br>TWQQGWVFSCSVMHEALHNHYTQKSLSLSPGK | Clone CH3C.18.3.2-17<br>(CH3C.3.2-17) |
| 429 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESFGIEWSSYKTTPPVLDSDGSFFLYSKLTVSKE<br>EWQQGFVFSCSVMHEALHNHYTQKSLSLSPGK | Clone CH3C.35.20.1.1 |
| 430 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESYGIEWANYKTTPPVLDSDGSFFLYSKLTVSKS<br>EWQQGFVFSCSVMHEALHNHYTQKSLSLSPGK | Clone CH3C.35.23.2.1 |
| 431 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESFGIEWSNYKTTPPVLDSDGSFFLYSKLTVSKE<br>EWQQGFVFSCSVMHEALHNHYTQKSLSLSPGK | Clone CH3C.35.23.1.1 |
| 432 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESYGIEWSSYKTTPPVLDSDGSFFLYSKLTVSKS<br>EWQQGFVFSCSVMHEALHNHYTQKSLSLSPGK | Clone CH3C.35.S413 |
| 433 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESYGIEWVNYKTTPPVLDSDGSFFLYSKLTVSKE<br>EWQQGFVFSCSVMHEALHNHYTQKSLSLSPGK | Clone CH3C.35.23.3.1 |
| 434 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESYGIEWSNYKTTPPVLDSDGSFFLYSKLTVSKS<br>EWQQGFVFSCSVMHEALHNHYTQKSLSLSPGK | Clone CH3C.35.N390.1 |
| 435 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCL<br>VKGFYPSDIAVEWESFGIEWVNYKTTPPVLDSDGSFFLYSKLTVSKE<br>EWQQGFVFSCSVMHEALHNHYTQKSLSLSPGK | Clone CH3C.35.23.6.1 |
| 436 | PCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLWCL<br>VKGFYPSDIAVWWESYGIEWSSYKTTPPVLDSDGSFFLYSKLTVTKE<br>EWQQGFVFSCSVMHEALHNHYTQKSLSLSPGK | Clone CH3C.35.21 with<br>knob mutation |
| 437 | PCPAPEAAGGPSVFLFPPKPKDTLMISRTPEVTCVVVDVSHEDPEVK<br>FNWYVDGVEVHNAKTKPREEQYNSTYRVVSVLTVLHQDWLNGKEYKC<br>KVSNKALPAPIEKTISKAKGQPREPQVYTLPPSRDELTKNQVSLWCL<br>VKGFYPSDIAVWWESYGTEWSSYKTTPPVLDSDGSFFLYSKLTVTKE<br>EWQQGFVFSCSVMHEALHNHYTQKSLSLSPGK | Clone CH3C.35.21 with<br>knob and LALA mutations |

Informal Sequence Listing

| SEQ ID NO: | Sequence | Description |
|---|---|---|
| 438 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVWWESYGTEWSSYKTTPPVLDSDGSFFLYSKLTVTKE EWQQGFVFSCSVMHEALHNHYTQKSLSLSPGK | Clone CH3C.35.21 with knob and LALAPG mutations |
| 439 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVWWESYGIEWSSYKTTPPVLDSDGSFFLYSKLTVTKE EWQQGFVFSCSVMHEALHNHYTQKSLSLSPGK | Clone CH3C.35.21 with knob and YTE mutations |
| 440 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVWWESYGIEWSSYKTTPPVLDSDGSFFLYSKLTVTKE EWQQGFVFSCSVMHEALHNHYTQKSLSLSPGK | Clone CH3C.35.21 with knob, LALA, and YTE mutations |
| 441 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVWWESYGIEWSSYKTTPPVLDSDGSFFLYSKLTVTKE EWQQGFVFSCSVMHEALHNHYTQKSLSLSPGK | Clone CH3C.35.21 with knob, LALAPG, and YTE mutations |
| 442 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVWWESYGIEWSSYKTTPPVLDSDGSFFLVSKLTVTKE EWQQGFVFSCSVMHEALHNHYTQKSLSLSPGK | Clone CH3C.35.21 with hole mutations |
| 443 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVWWESYGIEWSSYKTTPPVLDSDGSFFLVSKLTVTKE EWQQGFVFSCSVMHEALHNHYTQKSLSLSPGK | Clone CH3C.35.21 with hole and LALA mutations |
| 444 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVWWESYGIEWSSYKTTPPVLDSDGSFFLVSKLTVTKE EWQQGFVFSCSVMHEALHNHYTQKSLSLSPGK | Clone CH3C.35.21 with hole and LALAPG mutations |
| 445 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVWWESYGIEWSSYKTTPPVLDSDGSFFLVSKLTVTKE EWQQGFVFSCSVMHEALHNHYTQKSLSLSPGK | Clone CH3C.35.21 with hole and YTE mutations |
| 446 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVWWESYGIEWSSYKTTPPVLDSDGSFFLVSKLTVTKE EWQQGFVFSCSVMHEALHNHYTQKSLSLSPGK | Clone CH3C.35.21 with hole, LALA, and YTE mutations |
| 447 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVWWESYGIEWSSYKTTPPVLDSDGSFFLVSKLTVTKE EWQQGFVFSCSVMHEALHNHYTQKSLSLSPGK | Clone CH3C.35.21 with hole, LALAPG, and YTE mutations |
| 448 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGIEWSSYKTTPPVLDSDGSFFLYSKLTVSKE EWQQGFVFSCSVMHEALHNHYTQKSLSLSPGK | Clone CH3C.35.20.1.1 with knob mutation |
| 449 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGIEWSSYKTTPPVLDSDGSFFLYSKLTVSKE EWQQGFVFSCSVMHEALHNHYTQKSLSLSPGK | Clone CH3C.35.20.1.1 with knob and LALA mutations |

| SEQ ID NO: | Sequence | Description |
|---|---|---|
| 450 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESFGIEWSSYKTTPPVLDSDGSFFLYSKLTVSKE EWQQGFVFSCSVMHEALHNHYTQKSLSLSPGK | Clone CH3C.35.20.1.1 with knob and LALAPG mutations |
| 451 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGIEWSSYKTTPPVLDSDGSFFLYSKLTVSKE EWQQGFVFSCSVMHEALHNHYTQKSLSLSPGK | Clone CH3C.35.20.1.1 with knob and YTE mutations |
| 452 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGIEWSSYKTTPPVLDSDGSFFLYSKLTVSKE EWQQGFVFSCSVMHEALHNHYTQKSLSLSPGK | Clone CH3C.35.20.1.1 with knob, LALA, and YTE mutations |
| 453 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESFGIEWSSYKTTPPVLDSDGSFFLYSKLTVSKE EWQQGFVFSCSVMHEALHNHYTQKSLSLSPGK | Clone CH3C.35.20.1.1 with knob, LALAPG, and YTE mutations |
| 454 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSSYKTTPPVLDSDGSFFLVSKLTVSKE EWQQGFVFSCSVMHEALHNHYTQKSLSLSPGK | Clone CH3C.35.20.1.1 with hole mutations |
| 455 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSSYKTTPPVLDSDGSFFLVSKLTVSKE EWQQGFVFSCSVMHEALHNHYTQKSLSLSPGK | Clone CH3C.35.20.1.1 with hole and LALA mutations |
| 456 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESFGIEWSSYKTTPPVLDSDGSFFLVSKLTVSKE EWQQGFVFSCSVMHEALHNHYTQKSLSLSPGK | Clone CH3C.35.20.1.1 with hole and LALAPG mutations |
| 457 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSSYKTTPPVLDSDGSFFLVSKLTVSKE EWQQGFVFSCSVMHEALHNHYTQKSLSLSPGK | Clone CH3C.35.20.1.1 with hole and YTE mutations |
| 458 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSSYKTTPPVLDSDGSFFLVSKLTVSKE EWQQGFVFSCSVMHEALHNHYTQKSLSLSPGK | Clone CH3C.35.20.1.1 with hole, LALA, and YTE mutations |
| 459 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESFGIEWSSYKTTPPVLDSDGSFFLVSKLTVSKE EWQQGFVFSCSVMHEALHNHYTQKSLSLSPGK | Clone CH3C.35.20.1.1 with hole, LALAPG, and YTE mutations |
| 460 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGIEWANYKTTPPVLDSDGSFFLYSKLTVSKS EWQQGFVFSCSVMHEALHNHYTQKSLSLSPGK | Clone CH3C.35.23.2.1 with knob mutation |
| 461 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGTEWANYKTTPPVLDSDGSFFLYSKLTVSKS EWQQGFVFSCSVMHEALHNHYTQKSLSLSPGK | Clone CH3C.35.23.2.1 with knob and LALA mutations |
| 462 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC | Clone CH3C.35.23.2.1 with knob and LALAPG |

| SEQ ID NO: | Sequence | Description |
|---|---|---|
| | KVSNKALGAPIEKTISKAKGQPREPQVYTLPPSRDELTKNQVSLWCL VKGFYPSDIAVEWESYGTEWANYKTTPPVLDSDGSFFLYSKLTVSKS EWQQGFVFSCSVMHEALHNHYTQKSLSLSPGK | mutations |
| 463 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGIEWANYKTTPPVLDSDGSFFLYSKLTVSKS EWQQGFVFSCSVMHEALHNHYTQKSLSLSPGK | Clone CH3C.35.23.2.1 with knob and YTE mutations |
| 464 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGIEWANYKTTPPVLDSDGSFFLYSKLTVSKS EWQQGFVFSCSVMHEALHNHYTQKSLSLSPGK | Clone CH3C.35.23.2.1 with knob, LALA, and YTE mutations |
| 465 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESYGIEWANYKTTPPVLDSDGSFFLYSKLTVSKS EWQQGFVFSCSVMHEALHNHYTQKSLSLSPGK | Clone CH3C.35.23.2.1 with knob, LALAPG, and YTE mutations |
| 466 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWANYKTTPPVLDSDGSFFLYSKLTVSKS EWQQGFVFSCSVMHEALHNHYTQKSLSLSPGK | Clone CH3C.35.23.2.1 with hole mutations |
| 467 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWANYKTTPPVLDSDGSFFLYSKLTVSKS EWQQGFVFSCSVMHEALHNHYTQKSLSLSPGK | Clone CH3C.35.23.2.1 with hole and LALA mutations |
| 468 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESYGIEWANYKTTPPVLDSDGSFFLYSKLTVSKS EWQQGFVFSCSVMHEALHNHYTQKSLSLSPGK | Clone CH3C.35.23.2.1 with hole and LALAPG mutations |
| 469 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWANYKTTPPVLDSDGSFFLYSKLTVSKS EWQQGFVFSCSVMHEALHNHYTQKSLSLSPGK | Clone CH3C.35.23.2.1 with hole and YTE mutations |
| 470 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWANYKTTPPVLDSDGSFFLYSKLTVSKS EWQQGFVFSCSVMHEALHNHYTQKSLSLSPGK | Clone CH3C.35.23.2.1 with hole, LALA, and YTE mutations |
| 471 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESYGIEWANYKTTPPVLDSDGSFFLYSKLTVSKS EWQQGFVFSCSVMHEALHNHYTQKSLSLSPGK | Clone CH3C.35.23.2.1 with hole, LALAPG, and YTE mutations |
| 472 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGIEWSNYKTTPPVLDSDGSFFLYSKLTVSKE EWQQGFVFSCSVMHEALHNHYTQKSLSLSPGK | Clone CH3C.35.23.1.1 with knob mutation |
| 473 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGTEWSNYKTTPPVLDSDGSFFLYSKLTVSKE EWQQGFVFSCSVMHEALHNHYTQKSLSLSPGK | Clone CH3C.35.23.1.1 with knob and LALA mutations |

Informal Sequence Listing

| SEQ ID NO: | Sequence | Description |
|---|---|---|
| 474 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESFGTEWSNYKTTPPVLDSDGSFFLYSKLTVSKE EWQQGFVFSCSVMHEALHNHYTQKSLSLSPGK | Clone CH3C.35.23.1.1 with knob and LALAPG mutations |
| 475 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGIEWSNYKTTPPVLDSDGSFFLYSKLTVSKE EWQQGFVFSCSVMHEALHNHYTQKSLSLSPGK | Clone CH3C.35.23.1.1 with knob and YTE mutations |
| 476 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGIEWSNYKTTPPVLDSDGSFFLYSKLTVSKE EWQQGFVFSCSVMHEALHNHYTQKSLSLSPGK | Clone CH3C.35.23.1.1 with knob, LALA, and YTE mutations |
| 477 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESFGIEWSNYKTTPPVLDSDGSFFLYSKLTVSKE EWQQGFVFSCSVMHEALHNHYTQKSLSLSPGK | Clone CH3C.35.23.1.1 with knob, LALAPG, and YTE mutations |
| 478 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSNYKTTPPVLDSDGSFFLVSKLTVSKE EWQQGFVFSCSVMHEALHNHYTQKSLSLSPGK | Clone CH3C.35.23.1.1 with hole mutations |
| 479 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSNYKTTPPVLDSDGSFFLVSKLTVSKE EWQQGFVFSCSVMHEALHNHYTQKSLSLSPGK | Clone CH3C.35.23.1.1 with hole and LALA mutations |
| 480 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESFGIEWSNYKTTPPVLDSDGSFFLVSKLTVSKE EWQQGFVFSCSVMHEALHNHYTQKSLSLSPGK | Clone CH3C.35.23.1.1 with hole and LALAPG mutations |
| 481 | PCPAPELLGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSNYKTTPPVLDSDGSFFLVSKLTVSKE EWQQGFVFSCSVMHEALHNHYTQKSLSLSPGK | Clone CH3C.35.23.1.1 with hole and YTE mutations |
| 482 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSNYKTTPPVLDSDGSFFLVSKLTVSKE EWQQGFVFSCSVMHEALHNHYTQKSLSLSPGK | Clone CH3C.35.23.1.1 with hole, LALA, and YTE mutations |
| 483 | PCPAPEAAGGPSVFLFPPKPKDTLYITREPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESFGIEWSNYKTTPPVLDSDGSFFLVSKLTVSKE EWQQGFVFSCSVMHEALHNHYTQKSLSLSPGK | Clone CH3C.35.23.1.1 with hole, LALAPG, and YTE mutations |
| 484 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESFGIEWSSYKTTPPVLDSDGSFFLYSKLTVTKE EWQQGFVFSCSVLHEALHSHYTQKSLSLSPGK | Clone CH3C.35.20.1 M201L and N207S mutations |
| 485 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGIEWSSYKTTPPVLDSDGSFFLYSKLTVTKE EWQQGFVFSCSVLHEALHSHYTQKSLSLSPGK | Clone CH3C.35.20.1 with knob and M201L and N207S mutations |
| 486 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC | Clone CH3C.35.20.1 with knob, LALA, and M201L |

| SEQ ID NO: | Sequence | Description |
|---|---|---|
| | KVSNKALPAPIEKTISKAKGQPREPQVYTLPPSRDELTKNQVSLWCL VKGFYPSDIAVEWESFGIEWSSYKTTPPVLDSDGSFFLYSKLTVTKE EWQQGFVFSCSVLHEALHSHYTQKSLSLSPGK | and N207S mutations |
| 487 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESFGIEWSSYKTTPPVLDSDGSFFLYSKLTVTKE EWQQGFVFSCSVLHEALHSHYTQKSLSLSPGK | Clone CH3C.35.20.1 with knob, LALAPG, and M201L and N207S mutations |
| 488 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSSYKTTPPVLDSDGSFFLVSKLTVTKE EWQQGFVFSCSVLHEALHSHYTQKSLSLSPGK | Clone CH3C.35.20.1 with hole and M201L and N207S mutations |
| 489 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSSYKTTPPVLDSDGSFFLYSKLTVTKE EWQQGFVFSCSVLHEALHSHYTQKSLSLSPGK | Clone CH3C.35.20.1 with hole, LALA, and M201L and N207S mutations |
| 490 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESFGIEWSSYKTTPPVLDSDGSFFLYSKLTVTKE EWQQGFVFSCSVLHEALHSHYTQKSLSLSPGK | Clone CH3C.35.20.1 with hole, LALAPG, and M201L and N207S mutations |
| 491 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGIEWANYKTTPPVLDSDGSFFLYSKLTVTKE EWQQGFVFSCSVLHEALHSHYTQKSLSLSPGK | Clone CH3C.35.23.2 with M201L and N207S mutations |
| 492 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGIEWANYKTTPPVLDSDGSFFLYSKLTVTKE EWQQGFVFSCSVLHEALHSHYTQKSLSLSPGK | Clone CH3C.35.23.2 with knob and M201L and N207S mutations |
| 493 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGTEWANYKTTPPVLDSDGSFFLYSKLTVTKE EWQQGFVFSCSVLHEALHSHYTQKSLSLSPGK | Clone CH3C.35.23.2 with knob, LALA, and M201L and N207S mutations |
| 494 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESYGTEWANYKTTPPVLDSDGSFFLYSKLTVTKE EWQQGFVFSCSVLHEALHSHYTQKSLSLSPGK | Clone CH3C.35.23.2 with knob, LALAPG, and M201L and N207S mutations |
| 495 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWANYKTTPPVLDSDGSFFLYSKLTVTKE EWQQGFVFSCSVLHEALHSHYTQKSLSLSPGK | Clone CH3C.35.23.2 with hole and M201L and N207S mutations |
| 496 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWANYKTTPPVLDSDGSFFLYSKLTVTKE EWQQGFVFSCSVLHEALHSHYTQKSLSLSPGK | Clone CH3C.35.23.2 with hole, LALA, and M201L and N207S mutations |
| 497 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESYGIEWANYKTTPPVLDSDGSFFLYSKLTVTKE EWQQGFVFSCSVLHEALHSHYTQKSLSLSPGK | Clone CH3C.35.23.2 with hole, LALAPG, and M201L and N207S mutations |

-continued

Informal Sequence Listing

| SEQ ID NO: | Sequence | Description |
|---|---|---|
| 498 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGIEWVNYKTTPPVLDSDGSFFLYSKLTVTKE EWQQGFVFSCSVLHEALHSHYTQKSLSLSPGK | Clone CH3C.35.23.3 with M201L and N207S mutations |
| 499 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGIEWVNYKTTPPVLDSDGSFFLYSKLTVTKE EWQQGFVFSCSVLHEALHSHYTQKSLSLSPGK | Clone CH3C.35.23.3 with knob and M201L and N207S mutations |
| 500 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGTEWVNYKTTPPVLDSDGSFFLYSKLTVTKE EWQQGFVFSCSVLHEALHSHYTQKSLSLSPGK | Clone CH3C.35.23.3 with knob, LALA, and M201L and N207S mutations |
| 501 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESYGTEWVNYKTTPPVLDSDGSFFLYSKLTVTKE EWQQGFVFSCSVLHEALHSHYTQKSLSLSPGK | Clone CH3C.35.23.3 with knob, LALAPG, and M201L and N207S mutations |
| 502 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWVNYKTTPPVLDSDGSFFLYSKLTVTKE EWQQGFVFSCSVLHEALHSHYTQKSLSLSPGK | Clone CH3C.35.23.3 with hole and M201L and N207S mutations |
| 503 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWVNYKTTPPVLDSDGSFFLYSKLTVTKE EWQQGFVFSCSVLHEALHSHYTQKSLSLSPGK | Clone CH3C.35.23.3 with hole, LALA, and M201L and N207S mutations |
| 504 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESYGIEWVNYKTTPPVLDSDGSFFLYSKLTVTKE EWQQGFVFSCSVLHEALHSHYTQKSLSLSPGK | Clone CH3C.35.23.3 with hole, LALAPG, and M201L and N207S mutations |
| 505 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGIEWSNYKTTPPVLDSDGSFFLYSKLTVSKE EWQQGFVFSCSVLHEALHSHYTQKSLSLSPGK | Clone CH3C.35.23.4 with M201L and N207S mutations |
| 506 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGIEWSNYKTTPPVLDSDGSFFLYSKLTVSKE EWQQGFVFSCSVLHEALHSHYTQKSLSLSPGK | Clone CH3C.35.23.4 with knob and M201L and N207S mutations |
| 507 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGTEWSNYKTTPPVLDSDGSFFLYSKLTVSKE EWQQGFVFSCSVLHEALHSHYTQKSLSLSPGK | Clone CH3C.35.23.4 with knob, LALA, and M201L and N207S mutations |
| 508 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESYGTEWSNYKTTPPVLDSDGSFFLYSKLTVSKE EWQQGFVFSCSVLHEALHSHYTQKSLSLSPGK | Clone CH3C.35.23.4 with knob, LALAPG, and M201L and N207S mutations |
| 509 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGTEWSNYKTTPPVLDSDGSFFLVSKLTVSKE EWQQGFVFSCSVLHEALHSHYTQKSLSLSPGK | Clone CH3C.35.23.4 with hole and M201L and N207S mutations |
| 510 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC | Clone CH3C.35.23.4 with hole, LALA, and M201L |

| SEQ ID NO: | Sequence | Description |
|---|---|---|
| | KVSNKALPAPIEKTISKAKGQPREPQVYTLPPSRDELTKNQVSLSCA VKGFYPSDIAVEWESYGIEWSNYKTTPPVLDSDGSFFLVSKLTVSKE EWQQGFVFSCSVLHEALHSHYTQKSLSLSPGK | and N207S mutations |
| 511 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESYGIEWSNYKTTPPVLDSDGSFFLVSKLTVSKE EWQQGFVFSCSVLHEALHSHYTQKSLSLSPGK | Clone CH3C.35.23.4 with hole, LALAPG, and M201L and N207S mutations |
| 512 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVLWESYGIEWASYKTTPPVLDSDGSFFLYSKLTVTKE EWQQGFVFSCSVLHEALHSHYTQKSLSLSPGK | Clone CH3C.35.21.17.2 with M201L and N207S mutations |
| 513 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVLWESYGIEWASYKTTPPVLDSDGSFFLYSKLTVTKE EWQQGFVFSCSVLHEALHSHYTQKSLSLSPGK | Clone CH3C.35.21.17.2 with knob and M201L and N207S mutations |
| 514 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVLWESYGTEWASYKTTPPVLDSDGSFFLYSKLTVTKE EWQQGFVFSCSVLHEALHSHYTQKSLSLSPGK | Clone CH3C.35.21.17.2 with knob, LALA, and M201L and N207S mutations |
| 515 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVLWESYGTEWASYKTTPPVLDSDGSFFLYSKLTVTKE EWQQGFVFSCSVLHEALHSHYTQKSLSLSPGK | Clone CH3C.35.21.17.2 with knob, LALAPG, and M201L and N207S mutations |
| 516 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVLWESYGTEWASYKTTPPVLDSDGSFFLVSKLTVTKE EWQQGFVFSCSVLHEALHSHYTQKSLSLSPGK | Clone CH3C.35.21.17.2 with hole and M201L and N207S mutations |
| 517 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVLWESYGIEWASYKTTPPVLDSDGSFFLVSKLTVTKE EWQQGFVFSCSVLHEALHSHYTQKSLSLSPGK | Clone CH3C.35.21.17.2 with hole, LALA, and M201L and N207S mutations |
| 518 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVLWESYGIEWASYKTTPPVLDSDGSFFLVSKLTVTKE EWQQGFVFSCSVLHEALHSHYTQKSLSLSPGK | Clone CH3C.35.21.17.2 with hole, LALAPG, and M201L and N207S mutations |
| 519 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGIEWSNYKTTPPVLDSDGSFFLYSKLTVTKE EWQQGFVFSCSVLHEALHSHYTQKSLSLSPGK | Clone CH3C.35.23 with M201L and N207S mutations |
| 520 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGIEWSNYKTTPPVLDSDGSFFLYSKLTVTKE EWQQGFVFSCSVLHEALHSHYTQKSLSLSPGK | Clone CH3C.35.23 with knob and M201L and N207S mutations |
| 521 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGTEWSNYKTTPPVLDSDGSFFLYSKLTVTKE EWQQGFVFSCSVLHEALHSHYTQKSLSLSPGK | Clone CH3C.35.23 with knob, LALA, and M201L and N207S mutations |

-continued

Informal Sequence Listing

| SEQ ID NO: | Sequence | Description |
|---|---|---|
| 522 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESYGTEWSNYKTTPPVLDSDGSFFLYSKLTVTKE EWQQGFVFSCSVLHEALHSHYTQKSLSLSPGK | Clone CH3C.35.23 with knob, LALAPG, and M201L and N207S mutations |
| 523 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGTEWSNYKTTPPVLDSDGSFFLVSKLTVTKE EWQQGFVFSCSVLHEALHSHYTQKSLSLSPGK | Clone CH3C.35.23 with hole and M201L and N207S mutations |
| 524 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWSNYKTTPPVLDSDGSFFLVSKLTVTKE EWQQGFVFSCSVLHEALHSHYTQKSLSLSPGK | Clone CH3C.35.23 with hole, LALA, and M201L and N207S mutations |
| 525 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESYGIEWSNYKTTPPVLDSDGSFFLVSKLTVTKE EWQQGFVFSCSVLHEALHSHYTQKSLSLSPGK | Clone CH3C.35.23 with hole, LALAPG, and M201L and N207S mutations |
| 526 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVWWESYGIEWSSYKTTPPVLDSDGSFFLVSKLTVTKE EWQQGFVFSCSVLHEALHSHYTQKSLSLSPGK | Clone CH3C.35.21 with M201L and N207S mutations |
| 527 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVWWESYGIEWSSYKTTPPVLDSDGSFFLVSKLTVTKE EWQQGFVFSCSVLHEALHSHYTQKSLSLSPGK | Clone CH3C.35.21 with knob and M201L and N207S mutations |
| 528 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVWWESYGTEWSSYKTTPPVLDSDGSFFLVSKLTVTKE EWQQGFVFSCSVLHEALHSHYTQKSLSLSPGK | Clone CH3C.35.21 with knob, LALA, and M201L and N207S mutations |
| 529 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVWWESYGTEWSSYKTTPPVLDSDGSFFLVSKLTVTKE EWQQGFVFSCSVLHEALHSHYTQKSLSLSPGK | Clone CH3C.35.21 with knob, LALAPG, and M201L and N207S mutations |
| 530 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVWWESYGIEWSSYKTTPPVLDSDGSFFLVSKLTVTKE EWQQGFVFSCSVLHEALHSHYTQKSLSLSPGK | Clone CH3C.35.21 with hole and M201L and N207S mutations |
| 531 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVWWESYGIEWSSYKTTPPVLDSDGSFFLVSKLTVTKE EWQQGFVFSCSVLHEALHSHYTQKSLSLSPGK | Clone CH3C.35.21 with hole, LALA, and M201L and N207S mutations |
| 532 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVWWESYGIEWSSYKTTPPVLDSDGSFFLVSKLTVTKE EWQQGFVFSCSVLHEALHSHYTQKSLSLSPGK | Clone CH3C.35.21 with hole, LALAPG, and M201L and N207S mutations |
| 533 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESFGIEWSSYKTTPPVLDSDGSFFLYSKLTVSKE EWQQGFVFSCSVLHEALHSHYTQKSLSLSPGK | Clone CH3C.35.20.1.1 with M201L and N207S mutations |
| 534 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC | Clone CH3C.35.20.1.1 with knob and M201L and |

Informal Sequence Listing

| SEQ ID NO: | Sequence | Description |
|---|---|---|
| | KVSNKALPAPIEKTISKAKGQPREPQVYTLPPSRDELTKNQVSLWCL VKGFYPSDIAVEWESFGIEWSSYKTTPPVLDSDGSFFLYSKLTVSKE EWQQGFVFSCSVLHEALHSHYTQKSLSLSPGK | N207S mutations |
| 535 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGIEWSSYKTTPPVLDSDGSFFLYSKLTVSKE EWQQGFVFSCSVLHEALHSHYTQKSLSLSPGK | Clone CH3C.35.20.1.1 with knob, LALA, and M201L and N207S mutations |
| 536 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESFGIEWSSYKTTPPVLDSDGSFFLYSKLTVSKE EWQQGFVFSCSVLHEALHSHYTQKSLSLSPGK | Clone CH3C.35.20.1.1 with knob, LALAPG, and M201L and N207S mutations |
| 537 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSSYKTTPPVLDSDGSFFLYSKLTVSKE EWQQGFVFSCSVLHEALHSHYTQKSLSLSPGK | Clone CH3C.35.20.1.1 with hole and M201L and N207S mutations |
| 538 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSSYKTTPPVLDSDGSFFLYSKLTVSKE EWQQGFVFSCSVLHEALHSHYTQKSLSLSPGK | Clone CH3C.35.20.1.1 with hole, LALA, and M201L and N207S mutations |
| 539 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESFGIEWSSYKTTPPVLDSDGSFFLYSKLTVSKE EWQQGFVFSCSVLHEALHSHYTQKSLSLSPGK | Clone CH3C.35.20.1.1 with hole, LALAPG, and M201L and N207S mutations |
| 540 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESYGIEWANYKTTPPVLDSDGSFFLYSKLTVSKS EWQQGFVFSCSVLHEALHSHYTQKSLSLSPGK | Clone CH3C.35.23.2.1 with M201L and N207S mutations |
| 541 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGIEWANYKTTPPVLDSDGSFFLYSKLTVSKS EWQQGFVFSCSVLHEALHSHYTQKSLSLSPGK | Clone CH3C.35.23.2.1 with knob and M201L and N207S mutations |
| 542 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESYGTEWANYKTTPPVLDSDGSFFLYSKLTVSKS EWQQGFVFSCSVLHEALHSHYTQKSLSLSPGK | Clone CH3C.35.23.2.1 with knob, LALA, and M201L and N207S mutations |
| 543 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESYGTEWANYKTTPPVLDSDGSFFLYSKLTVSKS EWQQGFVFSCSVLHEALHSHYTQKSLSLSPGK | Clone CH3C.35.23.2.1 with knob, LALAPG, and M201L and N207S mutations |
| 544 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWANYKTTPPVLDSDGSFFLYSKLTVSKS EWQQGFVFSCSVLHEALHSHYTQKSLSLSPGK | Clone CH3C.35.23.2.1 with hole and M201L and N207S mutations |
| 545 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESYGIEWANYKTTPPVLDSDGSFFLYSKLTVSKS EWQQGFVFSCSVLHEALHSHYTQKSLSLSPGK | Clone CH3C.35.23.2.1 with hole, LALA, and M201L and N207S mutations |

| SEQ ID NO: | Sequence | Description |
|---|---|---|
| 546 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESYGIEWANYKTTPPVLDSDGSFFLVSKLTVSKS EWQQGFVFSCSVLHEALHSHYTQKSLSLSPGK | Clone CH3C.35.23.2.1 with hole, LALAPG, and M201L and N207S mutations |
| 547 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLTCL VKGFYPSDIAVEWESFGIEWSNYKTTPPVLDSDGSFFLYSKLTVSKE EWQQGFVFSCSVLHEALHSHYTQKSLSLSPGK | Clone CH3C.35.23.1.1 with M201L and N207S mutations |
| 548 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGIEWSNYKTTPPVLDSDGSFFLYSKLTVSKE EWQQGFVFSCSVLHEALHSHYTQKSLSLSPGK | Clone CH3C.35.23.1.1 with knob and M201L and N207S mutations |
| 549 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLWCL VKGFYPSDIAVEWESFGTEWSNYKTTPPVLDSDGSFFLYSKLTVSKE EWQQGFVFSCSVLHEALHSHYTQKSLSLSPGK | Clone CH3C.35.23.1.1 with knob, LALA, and M201L and N207S mutations |
| 550 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLWCL VKGFYPSDIAVEWESFGTEWSNYKTTPPVLDSDGSFFLYSKLTVSKE EWQQGFVFSCSVLHEALHSHYTQKSLSLSPGK | Clone CH3C.35.23.1.1 with knob, LALAPG, and M201L and N207S mutations |
| 551 | PCPAPELLGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSNYKTTPPVLDSDGSFFLVSKLTVSKE EWQQGFVFSCSVLHEALHSHYTQKSLSLSPGK | Clone CH3C.35.23.1.1 with hole and M201L and N207S mutations |
| 552 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALPAPIEKTISKAKGQPREPQVYTLPPSRDELTKNQVSLSCA VKGFYPSDIAVEWESFGIEWSNYKTTPPVLDSDGSFFLVSKLTVSKE EWQQGFVFSCSVLHEALHSHYTQKSLSLSPGK | Clone CH3C.35.23.1.1 with hole, LALA, and M201L and N207S mutations |
| 553 | PCPAPEAAGGPSVFLFPPKPKDTLMISRTPEVTCVVVDVSHEDPEVK FNWYVDGVEVHNAKTKPREEQYNSTYRVVSVLTVLHQDWLNGKEYKC KVSNKALGAPIEKTISKAKGQPREPQVYTLPPSRDELTKNQVSLSCA VKGFYPSDIAVEWESFGIEWSNYKTTPPVLDSDGSFFLVSKLTVSKE EWQQGFVFSCSVLHEALHSHYTQKSLSLSPGK | Clone CH3C.35.23.1.1 with hole, LALAPG, and M201L and N207S mutations |
| 554 | $X_1$WES$X_2$G$X_3$$X_4$W$X_5$$X_6$<br>$X_1$ is E, L, S, V, W, or Y;<br>$X_2$ is an aromatic amino acid (e.g., Y, F, or W), M, P, or V;<br>$X_3$ is T, N, or V;<br>$X_4$ is E, I, P, or V;<br>$X_5$ is an aliphatic amino acid (e.g., A, I, or V), S, or T;<br>and $X_6$ is S, N, R, or T | CH3C.35_consensus sequence_1 |
| 555 | $X_1$K$X_2$$X_3$WQQG$X_4$VF$X_5$C$X_6$<br>$X_1$ is T, H, or S;<br>$X_2$ is E, S, D, G, T, P, Q, or R;<br>$X_3$ is E or R; $X_4$ is F, H, K, Y, or W;<br>$X_5$ is S, T, or W;<br>and $X_6$ is S, C, P, M, or W | CH3C.35_consensus sequence_2 |

Informal Sequence Listing

| SEQ ID NO: | Sequence | Description |
|---|---|---|
| 556 | GQPREPQVYTLPPSRDELTKNQVSLTCLVKGFYPSDIAVX$_1$WESX$_2$G X$_3$X$_4$WX$_5$X$_6$YKTTPPVLDSDGSFFLYSKLTVX$_7$KX$_8$X$_9$WQQGX$_{10}$VFX$_{11}$ CX$_{12}$VMHEALHNHYTQKSLSLSPGK<br>X$_1$ is E, L, S, V, W, or Y;<br>X$_2$ is an aromatic amino acid (e.g., Y, F, or W), M, P, or V;<br>X$_3$ is T, N, or V;<br>X$_4$ is E, I, P, or V;<br>X$_5$ is an aliphatic amino acid (e.g., A, I, or V), S, or T;<br>X$_6$ is S, N, R, or T;<br>X$_7$ is T, H, or S;<br>X$_8$ is E, S, D, G, T, P, Q, or R;<br>X$_9$ is E or R;<br>X$_{10}$ is F, H, K, Y, or W;<br>X$_{11}$ is S, T, or W;<br>and X$_{12}$ is S, C, P, M, or W | CH3C.35_consensus sequence_3 |
| 557 | X$_1$WESX$_2$GX$_3$X$_4$WX$_5$X$_6$<br>X$_1$ is E, L, or W;<br>X$_2$ is an aromatic amino acid (e.g., Y or F);<br>X$_3$ is T;<br>X$_4$ is E;<br>X$_5$ is an aliphatic amino acid (e.g., A or V) or S;<br>and X$_6$ is S or N | CH3C.35_consensus sequence_4 |
| 558 | X$_1$KX$_2$X$_3$WQQGX$_4$VFX$_5$CX$_6$<br>X$_1$ is T or S;<br>X$_2$ is E or S;<br>X$_3$ is E;<br>X$_4$ is F, H, Y, or W;<br>X$_5$ is S;<br>and X$_6$ is S | CH3C.35_consensus sequence_5 |
| 559 | GQPREPQVYTLPPSRDELTKNQVSLTCLVKGFYPSDIAVX$_1$WESX$_2$G X$_3$X$_4$WX$_5$X$_6$YKTTPPVLDSDGSFFLYSKLTVX$_7$KX$_8$X$_9$WQQGX$_{10}$VFX$_{11}$ CX$_{12}$VMHEALHNHYTQKSLSLSPGK<br>X$_1$ is E, L, or W;<br>X$_2$ is an aromatic amino acid (e.g., Y or F);<br>X$_3$ is T;<br>X$_4$ is E;<br>X$_5$ is an aliphatic amino acid (e.g., A or V) or S;<br>X$_6$ is S or N;<br>X$_7$ is T or S;<br>X$_8$ is E or S;<br>X$_9$ is E;<br>X$_{10}$ is F, H, Y, or W;<br>X$_{11}$ is S;<br>and X$_{12}$ is S | CH3C.35_consensus sequence_6 |
| 560 | X$_1$WESX$_2$GX$_3$X$_4$WX$_5$X$_6$<br>X$_1$ is E, L, or W;<br>X$_2$ is Y or F;<br>X$_3$ is T;<br>X$_4$ is E;<br>X$_5$ is S, A or V;<br>and X$_6$ is S or N | CH3C.35_consensus sequence_7 |
| 561 | X$_1$KX$_2$X$_3$WQQGX$_4$VFX$_5$CX$_6$<br>X$_1$ is T or S;<br>X$_2$ is E or S;<br>X$_3$ is E;<br>X$_4$ is F;<br>X$_5$ is S;<br>and X$_6$ is S | CH3C.35_consensus sequence_8 |
| 562 | GQPREPQVYTLPPSRDELTKNQVSLTCLVKGFYPSDIAVX$_1$WESX$_2$G X$_3$X$_4$WX$_5$X$_6$YKTTPPVLDSDGSFFLYSKLTVX$_7$KX$_8$X$_9$WQQGX$_{10}$VFX$_{11}$ CX$_{12}$VMHEALHNHYTQKSLSLSPGK<br>X$_1$ is E, L, or W;<br>X$_2$ is Y or F;<br>X$_3$ is T; | CH3C.35_consensus sequence_9 |

-continued

Informal Sequence Listing

| SEQ ID NO: | Sequence | Description |
|---|---|---|
| | $X_4$ is E;<br>$X_5$ is S, A or V;<br>$X_6$ is S or N;<br>$X_7$ is T or S;<br>$X_8$ is E or S;<br>$X_9$ is E;<br>$X_{10}$ is F;<br>$X_{11}$ is S;<br>and $X_{12}$ is S | |
| 563 | GQPREPQVYTLPPSRDELTKNQVSLTCLVKGFYPSDIAVXWESYGIL<br>WSSYKTTPPVLDSDGSFFLYSKLTVTKEEWQQGFVFSCSVMHEALHN<br>HYTQKSLSLSPGK<br>X is E, L, S, V, W, or Y | CH3C.35_consensus sequence_10 |
| 564 | GQPREPQVYTLPPSRDELTKNQVSLTCLVKGFYPSDIAVWWESXGTE<br>WSSYKTTPPVLDSDGSFFLYSKLTVTKEEWQQGFVFSCSVMHEALHN<br>HYTQKSLSLSPGK<br>X is Y, F, M, P, V, or W | CH3C.35_consensus sequence_11 |
| 565 | GQPREPQVYTLPPSRDELTKNQVSLTCLVKGFYPSDIAVWWESYGXE<br>WSSYKTTPPVLDSDGSFFLYSKLTVTKEEWQQGFVFSCSVMHEALHN<br>HYTQKSLSLSPGK<br>X is T, N, or V | CH3C.35_consensus sequence_12 |
| 566 | GQPREPQVYTLPPSRDELTKNQVSLTCLVKGFYPSDIAVWWESYGTX<br>WSSYKTTPPVLDSDGSFFLYSKLTVTKEEWQQGFVFSCSVMHEALHN<br>HYTQKSLSLSPGK<br>X is E, I, P, or V | CH3C.35_consensus sequence_13 |
| 567 | GQPREPQVYTLPPSRDELTKNQVSLTCLVKGFYPSDIAVWWESYGTE<br>WXSYKTTPPVLDSDGSFFLYSKLTVTKEEWQQGFVFSCSVMHEALHN<br>HYTQKSLSLSPGK<br>X is S, A, I, T, or V | CH3C.35_consensus sequence_14 |
| 568 | GQPREPQVYTLPPSRDELTKNQVSLTCLVKGFYPSDIAVWWESYGTE<br>WSXYKTTPPVLDSDGSFFLYSKLTVTKEEWQQGFVFSCSVMHEALHN<br>HYTQKSLSLSPGK<br>X is S, N, R, or T | CH3C.35_consensus sequence_15 |
| 569 | GQPREPQVYTLPPSRDELTKNQVSLTCLVKGFYPSDIAVWWESYGTE<br>WSSYKTTPPVLDSDGSFFLYSKLTVXKEEWQQGFVFSCSVMHEALHN<br>HYTQKSLSLSPGK<br>X is T, H, or S | CH3C.35_consensus sequence_16 |
| 570 | GQPREPQVYTLPPSRDELTKNQVSLTCLVKGFYPSDIAVWWESYGTE<br>WSSYKTTPPVLDSDGSFFLYSKLTVTKXEWQQGFVFSCSVMHEALHN<br>HYTQKSLSLSPGK<br>X is E, S, D, G, T, P, Q, or R | CH3C.35_consensus sequence_17 |
| 571 | GQPREPQVYTLPPSRDELTKNQVSLTCLVKGFYPSDIAVWWESYGTE<br>WSSYKTTPPVLDSDGSFFLYSKLTVTKEXWQQGFVFSCSVMHEALHN<br>HYTQKSLSLSPGK<br>X is E or R | CH3C.35_consensus sequence_18 |
| 572 | GQPREPQVYTLPPSRDELTKNQVSLTCLVKGFYPSDIAVWWESYGTE<br>WSSYKTTPPVLDSDGSFFLYSKLTVTKEEWQQGXVFSCSVMHEALHN<br>HYTQKSLSLSPGK<br>X is F, H, K, or Y | CH3C.35_consensus sequence_19 |
| 573 | GQPREPQVYTLPPSRDELTKNQVSLTCLVKGFYPSDIAVWWESYGTE<br>WSSYKTTPPVLDSDGSFFLYSKLTVTKEEWQQGFVFXCSVMHEALHN<br>HYTQKSLSLSPGK<br>X is S, T, or W | CH3C.35_consensus sequence_20 |
| 574 | GQPREPQVYTLPPSRDELTKNQVSLTCLVKGFYPSDIAVWWESYGTE<br>WSSYKTTPPVLDSDGSFFLYSKLTVTKEEWQQGFVFSCXVMHEALHN<br>HYTQKSLSLSPGK<br>X is S, C, P, M, or W | CH3C.35_consensus sequence_21 |
| 575 | $X_1$WES$X_2$G$X_3X_4$W$X_5X_6X_7$<br>$X_1$ is E or W;<br>$X_2$ is V, W, L, or Y;<br>$X_3$ is L, P, F, T, or H; | CH3C.18_consensus sequence_1 |

| SEQ ID NO: | Sequence | Description |
|---|---|---|
| | $X_4$ is P, V, or E;<br>$X_5$ is A, S, V, or G;<br>$X_6$ is L, H, Q, G, V, A N, D, T, or E;<br>and $X_7$ is T, F, Q, V, or Y | |
| 576 | $X_1$KS$X_2$WQQG$X_3$<br>$X_1$ is L, S, E, A, or P;<br>$X_2$ is E, D, T, or N;<br>and $X_2$ is W, Y, H, or F | CH3C.18_consensus sequence_2 |
| 577 | GQPREPQVYTLPPSRDELTKNQVSLTCLVKGFYPSDIAV$X_1$WES$X_2$G $X_3X_4$W$X_5X_6X_7$KTTPPVLDSDGSFFLYSKLTV$X_8$KS$X_9$WQQG$X_{10}$VFSCS VMHEALHNHYTQKSLSLSPGK<br>$X_1$ is E or W;<br>$X_2$ is V, W, L, or Y;<br>$X_3$ is L, P, F, T, or H;<br>$X_4$ is P, V, or E;<br>$X_5$ is A, S, V, or G;<br>$X_6$ is L, H, Q, G, V, A N, D, T, or E;<br>$X_7$ is T, F, Q, V, or Y;<br>$X_8$ is L, S, E, A, or P;<br>$X_9$ is E, D, T, or N;<br>and $X_{10}$ is W, Y, H, or F | CH3C.18_consensus sequence_3 |
| 578 | $X_1$WES$X_2$G$X_3X_4$W$X_5X_6X_7$<br>$X_1$ is E or W;<br>$X_2$ is W, L, or Y;<br>$X_3$ is T or H;<br>$X_4$ is V;<br>$X_5$ is A, S, or V;<br>$X_6$ is V, T, or N;<br>and $X_7$ is Y or Q | CH3C.18_consensus sequence_4 |
| 579 | $X_1$KS$X_2$WQQG$X_3$<br>$X_1$ is P;<br>$X_2$ is T or N;<br>and $X_3$ is W, Y, H, or F | CH3C.18_consensus sequence_5 |
| 580 | GQPREPQVYTLPPSRDELTKNQVSLTCLVKGFYPSDIAV$X_1$WES$X_2$G $X_3X_4$W$X_5X_6X_7$KTTPPVLDSDGSFFLYSKLTV$X_8$KS$X_9$WQQG$X_{10}$VFSCS VMHEALHNHYTQKSLSLSPGK<br>$X_1$ is E or W;<br>$X_2$ is W, L, or Y;<br>$X_3$ is T or H;<br>$X_4$ is V;<br>$X_5$ is A, S, or V;<br>$X_6$ is V, T, or N;<br>$X_7$ is Y or Q;<br>$X_8$ is P;<br>$X_9$ is T or N;<br>and $X_{10}$ is W, Y, H, or F | CH3C.18_consensus sequence_6 |
| 581 | EWESFGTEWSS | CH3C modified binding sequence |
| 582 | SKEEWQQGF | CH3C modified binding sequence |
| 583 | EWESYGTEWAN | CH3C modified binding sequence |
| 584 | SKSEWQQGF | CH3C modified binding sequence |
| 585 | EWESFGTEWSN | CH3C modified binding sequence |
| 586 | SKEEWQQGF | CH3C modified binding sequence |

| Informal Sequence Listing | | |
|---|---|---|
| SEQ ID NO: | Sequence | Description |
| 587 | EWESYGTEWSS | CH3C modified binding sequence |
| 588 | SKSEWQQGF | CH3C modified binding sequence |
| 589 | EWESYGTEWVN | CH3C modified binding sequence |
| 590 | SKEEWQQGF | CH3C modified binding sequence |
| 591 | EWESYGTEWSN | CH3C modified binding sequence |
| 592 | SKSEWQQGF | CH3C modified binding sequence |
| 593 | EWESFGTEWVN | CH3C modified binding sequence |
| 594 | SKEEWQQGF | CH3C modified binding sequence |
| 595 | WGFVWSTY | CH3C modified binding sequence |
| 596 | PKSNWQQGF | CH3C modified binding sequence |
| 597 | WGHVWSTY | CH3C modified binding sequence |
| 598 | PKSNWQQGY | CH3C modified binding sequence |
| 599 | LGHVWVEQ | CH3C modified binding sequence |
| 600 | PKSTWQQGW | CH3C modified binding sequence |
| 601 | LGHVWVGV | CH3C modified binding sequence |
| 602 | PKSTWQQGW | CH3C modified binding sequence |
| 603 | LGHVWVHT | CH3C modified binding sequence |
| 604 | PKSTWQQGW | CH3C modified binding sequence |
| 605 | WGTVWGTY | CH3C modified binding sequence |
| 606 | PKSNWQQGY | CH3C modified binding sequence |
| 607 | LGHVWVGT | CH3C modified binding sequence |
| 608 | PKSTWQQGW | CH3C modified binding sequence |
| 609 | XWESYGTEWSS<br>X is E, L, S, V, W, or Y | CH3C modified binding sequence |
| 610 | WWESXGTEWSS<br>X is Y, F, M, P, V, or W | CH3C modified binding sequence |
| 611 | WWESYGXEWSS<br>X is T, N, or V | CH3C modified binding sequence |

| Informal Sequence Listing | | |
|---|---|---|
| SEQ ID NO: | Sequence | Description |
| 612 | WWESYGTXWSS<br>X is E, I, P, or V | CH3C modified binding sequence |
| 613 | WWESYGTEWXS<br>X is S, A, I, T, or V | CH3C modified binding sequence |
| 614 | WWESYGTEWSX<br>X is S, N, R, or T | CH3C modified binding sequence |
| 615 | XKEEWQQGFVFSCS<br>X is T, H, or S | CH3C modified binding sequence |
| 616 | TKXEWQQGFVFSCS<br>X is E, S, D, G, T, P, Q, or R | CH3C modified binding sequence |
| 617 | TKEXWQQGFVFSCS<br>X is E or R | CH3C modified binding sequence |
| 618 | TKEEWQQGXVFSCS<br>X is F, H, K, or Y | CH3C modified binding sequence |
| 619 | TKEEWQQGFVFXCS<br>X is S, T, or W | CH3C modified binding sequence |
| 620 | TKEEWQQGFVFSCX<br>X is S, C, P, M, or W | CH3C modified binding sequence |
| 621 | TXWSX | Clone motif |
| 622 | NSVIIVDKNGRLVYLVENPGGYVAYSKAATVTGKLVHANFGTKKDFE DLDSPVNGSIVIVRAGKITFAEKVANAESLNAIGVLIYMDQTKFPIV NAXLSFFGHAHLGTGDPYTPGFPSFNHTQFPPSRSSGLPNIPVQTIS RAAAEKLFGNMEGDCPSDWKTDSTCRMVTSENKNVKLTVS<br>X is D or E | Consensus sequence between human and cyno TfR |
| 623 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPE VTCVVVDVSHEDPEVKFNWYVDGVEVHNAKTKPREEQYNSTYRVVSV LTVLHQDWLNGKEYKCKVSNKALPAPIEKTISKAKGQPREPQVYTLP PSRDELTKNQVSLTCLVKGFYPSDIAVEWESNGQPENNYKTTPPVLD SDGSFFLYSKLTVDKSRWQQGNVFSCSVMHEALHNHYTQKSLSLSPG K | IGHG1_P01857 |
| 624 | ASTKGPSVFPLAPCSRSTSESTAALGCLVKDYFPEPVTVSWNSGALT SGVHTFPAVLQSSGLYSLSSVVTVPSSNFGTQTYTCNVDHKPSNTKV DKTVERKCCVECPPCPAPPVAGPSVFLFPPKPKDTLMISRTPEVTCV VVDVSHEDPEVQFNWYVDGVEVHNAKTKPREEQFNSTFRVVSVLTVV HQDWLNGKEYKCKVSNKGLPAPIEKTISKTKGQPREPQVYTLPPSRE EMTKNQVSLTCLVKGFYPSDISVEWESNGQPENNYKTTPPMLDSDGS FFLYSKLTVDKSRWQQGNVFSCSVMHEALHNHYTQKSLSLSPGK | IGHG2_P01859 |
| 625 | ASTKGPSVFPLAPCSRSTSGGTAALGCLVKDYFPEPVTVSWNSGALT SGVHTFPAVLQSSGLYSLSSVVTVPSSSLGTQTYTCNVNHKPSNTKV DKRVELKTPLGDTTHTCPRCPEPKSCDTPPPCPRCPEPKSCDTPPPC PRCPEPKSCDTPPPCPRCPAPELLGGPSVFLFPPKPKDTLMISRTPE VTCVVVDVSHEDPEVQFKWYVDGVEVHNAKTKPREEQYNSTFRVVSV LTVLHQDWLNGKEYKCKVSNKALPAPIEKTISKTKGQPREPQVYTLP PSREEMTKNQVSLTCLVKGFYPSDIAVEWESSGQPENNYNTTPPMLD SDGSFFLYSKLTVDKSRWQQGNIFSCSVMHEALHNRFTQKSLSLSPG K | IGHG3_P01860 |
| 626 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPSCPAPEFLGGPSVFLFPPKPKDTLMISRTPEVTC VVVDVSQEDPEVQFNWYVDGVEVHNAKTKPREEQFNSTYRVVSVLTV LHQDWLNGKEYKCKVSNKGLPSSIEKTISKAKGQPREPQVYTLPPSQ EEMTKNQVSLTCLVKGFYPSDIAVEWESNGQPENNYKTTPPVLDSDG SFFLYSRLTVDKSRWQEGNVFSCSVMHEALHNHYTQKSLSLSLGK | IGHG4_P01861 |

SEQUENCE LISTING (626 sequences)

SEQ ID NO: 1 - protein, 220 aa, Homo sapiens
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2 - protein, 113 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 3 - protein, 107 aa, Artificial Sequence
  Synthetic construct
GQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGLVWVGYKTTPPVLDSDGSFFLYSKLTVAKSTWQQGWVFSCSVMHEALHNHYTQKSLSLSPGK

SEQ ID NO: 5 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTVWSHYKTTPPVLDSDGSFFLYSKLTVSKSEWQQGYVFSCSVMHEALHNHYTQKSLSLSPGK

SEQ ID NO: 6 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSQYKTTPPVLDSDGSFFLYSKLTVEKSDWQQGHVFSCSVMHEALHNHYTQKSLSLSPGK

SEQ ID NO: 7 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESVGTPWALYKTTPPVLDSDGSFFLYSKLTVLKSEWQQGWVFSCSVMHEALHNHYTQKSLSLSPGK

SEQ ID NO: 8 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTVWSKYKTTPPVLDSDGSFFLYSKLTVSKSEWQQGFVFSCSVMHEALHNHYTQKSLSLSPGK

SEQ ID NO: 9 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWAVYKTTPPVLDSDGSFFLYSKLTVPKSTWQQGWVFSCSVMHEALHNHYTQKSLSLSPGK

SEQ ID NO: 10 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGLVWVGYKTTPPVLDSDGSFFLYSKLTVPKSTWQQGWVFSCSVMHEALHNHYTQKSLSLSPGK

SEQ ID NO: 11 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESMGHVWVGYKTTPPVLDSDGSFFLYSKLTVDKSTWQQGWVFSCSVMHEALHNHYTQKSLSLSPGK

SEQ ID NO: 12 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGLVWVFSKTTPPVLDSDGSFFLYSKLTVPKSTWQQGWVFSCSVMHEALHNHYTQKSLSLSPGK

SEQ ID NO: 13 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYKTTPPVLDSDGSFFLYSKLTVTKSEWQQGFVFSCSVMHEALHNHYTQKSLSLSPGK

SEQ ID NO: 14 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVSKSEWQQGFVFSCSVMHEALHNHYTQKSLSLSPGK

SEQ ID NO: 15 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVGYKTTPPVLDSDGSFFLYSKLTVSKSEWQQGWVFSCSVMHEALHNHYTQKSLSLSPGK

SEQ ID NO: 16 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVATKTTPPVLDSDGSFFLYSKLTVPKSTWQQGWVFSCSVMHEALHNHYTQKSLSLSPGK

SEQ ID NO: 17 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGPVWVHTKTTPPVLDSDGSFFLYSKLTVPKSTWQQGWVFSCSVMHEALHNHYTQKSLSLSPGK

SEQ ID NO: 18 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVDQKTTPPVLDSDGSFFLYSKLTVPKSTWQQGWVFSCSVMHEALHNHYTQKSLSLSPGK

SEQ ID NO: 19 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVNQKTTPPVLDSDGSFFLYSKLTVPKSTWQQGWVFSCSVMHEALHNHYTQKSLSLSPGK

SEQ ID NO: 20 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVNFKTTPPVLDSDGSFFLYSKLTVPKSTWQQGWVFSCSVMHEALHNHYTQKSLSLSPGK

SEQ ID NO: 21 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESLGHVWAVYKTTPPVLDSDGSFFLYSKLTVPKSTWQQGWVFSCSVMHEALHNHYTQKSLSLSPGK

SEQ ID NO: 22 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWAVYQTTPPVLDSDGSFFLYSKLTVPKSTWQQGWVFSCSVMHEALHNHYTQKSLSLSPGK

SEQ ID NO: 23 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESLGHVWAVYQTTPPVLDSDGSFFLYSKLTVPKSTWQQGWVFSCSVMHEALHNHYTQKSLSLSPGK

SEQ ID NO: 24 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYKTTPPVLDSDGSFFLYSKLTVTKSEWQQGFVFSCSVMHEALHNHYTQKSLSLSPGK

SEQ ID NO: 25 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYKTTPPVLDSDGSFFLYSKLTVTKEEWQQGFVFSCSVMHEALHNHYTQKSLSLSPGK

SEQ ID NO: 26 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 27 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVTKSEWQQGFVFSCSVMHEALHNHYTQKSLSLSPGK

SEQ ID NO: 28 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYQTTPPVLDSDGSFFLYSKLTVTKSEWQQGFVFSCSVMHEALHNHYTQKSLSLSPGK

SEQ ID NO: 29 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYQTTPPVLDSDGSFFLYSKLTVTKSEWQQGFVFSCSVMHEALHNHYTQKSLSLSPGK

SEQ ID NO: 30 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDYVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 31 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDMVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 32 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFEYVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 33 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFEMVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 34 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFELVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 35 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFEIVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 36 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDIVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 37 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDYVYTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 38 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFGMVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 39 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFADVTILPPSRDELTKNQVSLTCLVKGFYPSDIAVEWESNGQPENNYKTTPPVLDSDGSFFLYSKLTVDKSRWQQGNVFSCSVMHEALHNHYGFYDLSLSPGK

SEQ ID NO: 40 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFGLVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 41 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDYVTTLPPSRDELTKNQVSLTCLVKGFYPSDIAVEWESNGQPENNYKTTPPVLDSDGSFFLYSKLTVDKSRWQQGNVFSCSVMHEALHNHYGFSDLSLSPGK

SEQ ID NO: 42 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRIDYVTTLPPSRDELTKNQVSLTCLVKGFYPSDIAVEWESNGQPENNYKTTPPVLDSDGSFFLYSKLTVDKSRWQQGNVFSCSVMHEALHNHYGFSDLSLSPGK

SEQ ID NO: 43 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFKDVTILPPSRDELTKNQVSLTCLVKGFYPSDIAVEWESNGQPENNYKTTPPVLDSDGSFFLYSKLTVDKSRWQQGNVFSCSVMHEALHNHYGFFDLSLSPGK

SEQ ID NO: 44 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDLVTILPPSRDELTKNQVSLTCLVKGFYPSDIAVEWESNGQPENNYKTTPPVLDSDGSFFLYSKLTVDKSRWQQGNVFSCSVMHEALHNHYGFYDLSLSPGK

SEQ ID NO: 45 - protein, 220 aa, Artificial Sequence; identical to SEQ ID NO: 42
  Synthetic construct

SEQ ID NO: 46 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFELVATLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 47 - protein, 220 aa, Artificial Sequence
  Synthetic construct
PCPAPELLGGPSVFLFPPKPKDTLMISRTPEVTCVVVDVSHEDPEVEFIWYVDGVDVRYEWQLPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 48 - protein, 220 aa, Artificial Sequence
  Synthetic construct
PCPAPELLGGPSVFLFPPKPKDTLMISRTPEVTCVVVDVSHEDPEVGFVWYVDGVPVSWEWYWPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - protein, 220 aa, Artificial Sequence
  Synthetic construct
PCPAPELLGGPSVFLFPPKPKDTLMISRTPEVTCVVVDVSHEDPEVQFDWYVDGVMVRREWHRPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - protein, 220 aa, Artificial Sequence
  Synthetic construct
PCPAPELLGGPSVFLFPPKPKDTLMISRTPEVTCVVVDVSHEDPEVSFEWYVDGVPVRWEWQWPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 51 - protein, 220 aa, Artificial Sequence
  Synthetic construct
PCPAPELLGGPSVFLFPPKPKDTLMISRTPEVTCVVVDVSHEDPEVAFTWYVDGVPVRWEWQNPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 52 - protein, 220 aa, Artificial Sequence
  Synthetic construct
PCPAPELLGGPSVFLFPPKPKDTLMISRTPEVTCVVVDVSHEDPEVNFDWYVDGVLVRREWHRPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 53 - protein, 220 aa, Artificial Sequence
  Synthetic construct
PCPAPELLGGPSVFLFPPKPKDTLMISRTPEVTCVVVDVSHEDPEVQFVWYVDGVAVRWEWIRPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 220 aa, Artificial Sequence
  Synthetic construct
PCPAPELLGGPSVFLFPPKPKDTLMISRTPEVTCVVVDVSHEDPEVEFIWYVDGVEVAWEWFWPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 55 - protein, 220 aa, Artificial Sequence
  Synthetic construct
PCPAPELLGGPSVFLFPPKPKDTLMISRTPEVTCVVVDVSHEDPEVGFAWYVDGVNVRVEWQYPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 220 aa, Artificial Sequence
  Synthetic construct
PCPAPELLGGPSVFLFPPKPKDTLMISRTPEVTCVVVDVSHEDPEVGFVWYVDGVEVRREWVRPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - protein, 220 aa, Artificial Sequence
  Synthetic construct
PCPAPELLGGPSVFLFPPKPKDTLMISRTPEVTCVVVDVSHEDPEVSFDWYVDGVLVRREWQRPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - protein, 220 aa, Artificial Sequence
  Synthetic construct
PCPAPELLGGPSVFLFPPKPKDTLMISRTPEVTCVVVDVSHEDPEVEFTWYVDGVDVRYEWYYPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 59 - protein, 220 aa, Artificial Sequence
  Synthetic construct
PCPAPELLGGPSVFLFPPKPKDTLMISRTPEVTCVVVDVSHEDPEVQFTWYVDGVDVRYEWVRPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - protein, 220 aa, Artificial Sequence
  Synthetic construct
PCPAPELLGGPSVFLFPPKPKDTLMISRTPEVTCVVVDVSHEDPEVQFYWYVDGVNVRREWHRPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 220 aa, Artificial Sequence
  Synthetic construct
PCPAPELLGGPSVFLFPPKPKDTLMISRTPEVTCVVVDVSHEDPEVYFDWYVDGVMVRREWHRPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - protein, 220 aa, Artificial Sequence
  Synthetic construct
PCPAPELLGGPSVFLFPPKPKDTLMISRTPEVTCVVVDVSHEDPEVWFEWYVDGVFVGVAYDVPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 220 aa, Artificial Sequence
  Synthetic construct
PCPAPELLGGPSVFLFPPKPKDTLMISRTPEVTCVVVDPQTPPWEVKFNWYVDGVEVHNAKTKPREEEYYTYYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 220 aa, Artificial Sequence
  Synthetic construct
PCPAPELLGGPSVFLFPPKPKDTLMISRTPEVTCVVVDPPSPPWEVKFNWYVDGVEVHNAKTKPREEEYYSNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 220 aa, Artificial Sequence
  Synthetic construct
PCPAPELLGGPSVFLFPPKPKDTLMISRTPEVTCVVVDPQTPPWEVKFNWYVDGVEVHNAKTKPREEEYYSNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 220 aa, Artificial Sequence
  Synthetic construct
PCPAPELLGGPSVFLFPPKPKDTLMISRTPEVTCVVVDFRGPPWEVKFNWYVDGVEVHNAKTKPREEEYYHDYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - protein, 220 aa, Artificial Sequence
  Synthetic construct
PCPAPELLGGPSVFLFPPKPKDTLMISRTPEVTCVVVDPQTVPWEVKFNWYVDGVEVHNAKTKPREEEYYSNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - protein, 220 aa, Artificial Sequence
  Synthetic construct
PCPAPELLGGPSVFLFPPKPKDTLMISRTPEVTCVVVDPKMPPWEVKFNWYVDGVEVHNAKTKPREEEYYTYYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 69 - protein, 220 aa, Artificial Sequence
  Synthetic construct
PCPAPELLGGPSVFLFPPKPKDTLMISRTPEVTCVVVDPPVPPWEVKFNWYVDGVEVHNAKTKPREEEYYSNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - protein, 220 aa, Artificial Sequence
  Synthetic construct
PCPAPELLGGPSVFLFPPKPKDTLMISRTPEVTCVVVDPAFPPWEVKFNWYVDGVEVHNAKTKPREEEYYQNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - protein, 220 aa, Artificial Sequence
  Synthetic construct
PCPAPELLGGPSVFLFPPKPKDTLMISRTPEVTCVVVDAIWPPWEVKFNWYVDGVEVHNAKTKPREEEYYSNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 72 - protein, 220 aa, Artificial Sequence
  Synthetic construct
PCPAPELLGGPSVFLFPPKPKDTLMISRTPEVTCVVVDPPVAPWEVKFNWYVDGVEVHNAKTKPREEEYYSSYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 220 aa, Artificial Sequence
  Synthetic construct
PCPAPELLGGPSVFLFPPKPKDTLMISRTPEVTCVVVDPQMPPQEVKFNWYVDGVEVHNAKTKPREEEYYSNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 220 aa, Artificial Sequence
  Synthetic construct
PCPAPELLGGPSVFLFPPKPKDTLMISRTPEVTCVVVDPQTAPWEVKFNWYVDGVEVHNAKTKPREEEYYTYYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 220 aa, Artificial Sequence
  Synthetic construct
PCPAPELLGGPSVFLFPPKPKDTLMISRTPEVTCVVVDPQTPPQEVKFNWYVDGVEVHNAKTKPREEEYYSNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 220 aa, Artificial Sequence; identical to SEQ ID NO: 63
  Synthetic construct

SEQ ID NO: 77 - protein, 220 aa, Artificial Sequence
  Synthetic construct
PCPAPELLGGPSVFLFPPKPKDTLMISRTPEVTCVVVDPRVPPWEVKFNWYVDGVEVHNAKTKPREEEYYQNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 220 aa, Artificial Sequence
  Synthetic construct
PCPAPELLGGPSVFLFPPKPKDTLMISRTPEVTCVVVDPSVPPWEVKFNWYVDGVEVHNAKTKPREEEYYSNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 220 aa, Artificial Sequence
  Synthetic construct
PCPAPELLGGPSVFLFPPKPKDTLMISRTPEVTCVVVDMLWPVPEVKFNWYVDGVEVHNAKTKPREEVYHRPYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 220 aa, Artificial Sequence
  Synthetic construct
PCPAPELLGGPSVFLFPPKPKDTLMISRTPEVTCVVVDMLWPVPEVKFNWYVDGVEVHNAKTKPREETYHNPYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - protein, 220 aa, Artificial Sequence
  Synthetic construct
PCPAPELLGGPSVFLFPPKPKDTLMISRTPEVTCVVVDMEWPVTEVKFNWYVDGVEVHNAKTKPREETYHNPYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 220 aa, Artificial Sequence
  Synthetic construct
PCPAPELLGGPSVFLFPPKPKDTLMISRTPEVTCVVVDMLWPVPEVKFNWYVDGVEVHNAKTKPREETYHHPYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - protein, 220 aa, Artificial Sequence
  Synthetic construct
PCPAPELLGGPSVFLFPPKPKDTLMISRTPEVTCVVVDDDLTFQEVKFNWYVDGVEVHNAKTKPREEVYVTPYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 220 aa, Artificial Sequence
  Synthetic construct
PCPAPELLGGPSVFLFPPKPKDTLMISRTPEVTCVVVDDDLTFQEVKFNWYVDGVEVHNAKTKPREELYVTPYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 220 aa, Artificial Sequence
  Synthetic construct
PCPAPELLGGPSVFLFPPKPKDTLMISRTPEVTCVVVDAYGDPEEVKFNWYVDGVEVHNAKTKPREEWYDVPYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - protein, 220 aa, Artificial Sequence
  Synthetic construct
PCPAPELLGGPSVFLFPPKPKDTLMISRTPEVTCVVVDVSVPPRMVKFNWYVDGVEVHNAKTKSLTSQHNSTVRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 220 aa, Artificial Sequence
  Synthetic construct
PCPAPELLGGPSVFLFPPKPKDTLMISRTPEVTCVVVDVSVPPWMVKFNWYVDGVEVHNAKTKSLTSQHNSTVRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 220 aa, Artificial Sequence
  Synthetic construct
PCPAPELLGGPSVFLFPPKPKDTLMISRTPEVTCVVVDVSDMWEYVKFNWYVDGVEVHNAKTKPWVKQLNSTWRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 89 - protein, 220 aa, Artificial Sequence
  Synthetic construct
PCPAPELLGGPSVFLFPPKPKDTLMISRTPEVTCVVVDVSDDWTWVKFNWYVDGVEVHNAKTKPWIAQPNSTWRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 220 aa, Artificial Sequence
  Synthetic construct
PCPAPELLGGPSVFLFPPKPKDTLMISRTPEVTCVVVDVSDDWEWVKFNWYVDGVEVHNAKTKPWKLQLNSTWRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 91 - protein, 220 aa, Artificial Sequence
  Synthetic construct
PCPAPELLGGPSVFLFPPKPKDTLMISRTPEVTCVVVDVSHEDPWVWFYWYVDGVEVHNAKTKPREEQYNSTYRVVSVLTVLHQDWLNGKEYKCSVVNIALWWSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 92 - protein, 220 aa, Artificial Sequence
  Synthetic construct
PCPAPELLGGPSVFLFPPKPKDTLMISRTPEVTCVVVDVSHEDPVVGFRWYVDGVEVHNAKTKPREEQYNSTYRVVSVLTVLHQDWLNGKEYKCRVSNSALTWKIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 220 aa, Artificial Sequence
  Synthetic construct
PCPAPELLGGPSVFLFPPKPKDTLMISRTPEVTCVVVDVSHEDPVVGFRWYVDGVEVHNAKTKPREEQYNSTYRVVSVLTVLHQDWLNGKEYKCRVSNSALSWRIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 94 - protein, 220 aa, Artificial Sequence
  Synthetic construct
PCPAPELLGGPSVFLFPPKPKDTLMISRTPEVTCVVVDVSHEDPIVGFRWYVDGVEVHNAKTKPREEQYNSTYRVVSVLTVLHQDWLNGKEYKCRVSNSALRWRIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 220 aa, Artificial Sequence
  Synthetic construct
PCPAPELLGGPSVFLFPPKPKDTLMISRTPEVTCVVVDVSHEDPAVGFEWYVDGVEVHNAKTKPREEQYNSTYRVVSVLTVLHQDWLNGKEYKCQVFNWALDWVIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 220 aa, Artificial Sequence
  Synthetic construct
  misc_feature (47)..(47): Xaa can be any naturally occurring amino acid
  misc_feature (49)..(49): Xaa can be any naturally occurring amino acid
  misc_feature (56)..(56): Xaa can be any naturally occurring amino acid
  misc_feature (58)..(63): Xaa can be any naturally occurring amino acid
PCPAPELLGGPSVFLFPPKPKDTLMISRTPEVTCVVVDVSHEDPEVXFXWYVDGVXVXXXXXXPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 220 aa, Artificial Sequence
  Synthetic construct
  misc_feature (39)..(44): Xaa can be any naturally occurring amino acid
  misc_feature (68)..(68): Xaa can be any naturally occurring amino acid
  misc_feature (70)..(72): Xaa can be any naturally occurring amino acid
PCPAPELLGGPSVFLFPPKPKDTLMISRTPEVTCVVVDXXXXXXEVKFNWYVDGVEVHNAKTKPREEXYXXXYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 98 - protein, 220 aa, Artificial Sequence
  Synthetic construct
  misc_feature (41)..(45): Xaa can be any naturally occurring amino acid
  misc_feature (65)..(67): Xaa can be any naturally occurring amino acid
  misc_feature (69)..(69): Xaa can be any naturally occurring amino acid
  misc_feature (73)..(73): Xaa can be any naturally occurring amino acid
PCPAPELLGGPSVFLFPPKPKDTLMISRTPEVTCVVVDVSXXXXXVKFNWYVDGVEVHNAKTKPXXXQXNSTXRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - protein, 220 aa, Artificial Sequence
  Synthetic construct
  misc_feature (45)..(45): Xaa can be any naturally occurring amino acid
  misc_feature (47)..(47): Xaa can be any naturally occurring amino acid
  misc_feature (49)..(49): Xaa can be any naturally occurring amino acid
  misc_feature (95)..(95): Xaa can be any naturally occurring amino acid
  misc_feature (97)..(97): Xaa can be any naturally occurring amino acid
  misc_feature (99)..(99): Xaa can be any naturally occurring amino acid
  misc_feature (102)..(104): Xaa can be any naturally occurring amino acid
PCPAPELLGGPSVFLFPPKPKDTLMISRTPEVTCVVVDVSHEDPXVXFXWYVDGVEVHNAKTKPREEQYNSTYRVVSVLTVLHQDWLNGKEYKCXVXNXALXXXIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 220 aa, Artificial Sequence
  Synthetic construct
  misc_feature (118)..(120): Xaa can be any naturally occurring amino acid
  misc_feature (122)..(122): Xaa can be any naturally occurring amino acid
  misc_feature (210)..(213): Xaa can be any naturally occurring amino acid
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRXXXVXTLPPSRDELTKNQVSLTCLVKGFYPSDIAVEWESNGQPENNYKTTPPVLDSDGSFFLYSKLTVDKSRWQQGNVFSCSVMHEALHNHYXXXXLSLSPGK

SEQ ID NO: 101 - protein, 220 aa, Artificial Sequence
  Synthetic construct
  misc_feature (127)..(129): Xaa can be any naturally occurring amino acid
  misc_feature (131)..(134): Xaa can be any naturally occurring amino acid
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDYVTTLPPXXXEXXXXQVSLTCLVKGFYPSDIAVEWESNGQPENNYKTTPPVLDSDGSFFLYSKLTVDKSRWQQGNVFSCSVMHEALHNHYGFSDLSLSPGK

SEQ ID NO: 102 - protein, 220 aa, Artificial Sequence
  Synthetic construct
  misc_feature (121)..(121): Xaa can be any naturally occurring amino acid
  misc_feature (206)..(207): Xaa can be any naturally occurring amino acid
  misc_feature (209)..(209): Xaa can be any naturally occurring amino acid
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDYXTTLPPSRDELTKNQVSLTCLVKGFYPSDIAVEWESNGQPENNYKTTPPVLDSDGSFFLYSKLTVDKSRWQQGNVFSCSVMHEALXXHXGFSDLSLSPGK

SEQ ID NO: 103 - protein, 220 aa, Artificial Sequence
  Synthetic construct
  misc_feature (125)..(125): Xaa can be any naturally occurring amino acid
  misc_feature (214)..(214): Xaa can be any naturally occurring amino acid
  misc_feature (217)..(220): Xaa can be any naturally occurring amino acid
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDYVTTLXPSRDELTKNQVSLTCLVKGFYPSDIAVEWESNGQPENNYKTTPPVLDSDGSFFLYSKLTVDKSRWQQGNVFSCSVMHEALHNHYGFSDXSLXXXX

SEQ ID NO: 104 - protein, 220 aa, Artificial Sequence
  Synthetic construct
  misc_feature (115)..(115): Xaa can be any naturally occurring amino acid
  misc_feature (117)..(117): Xaa can be any naturally occurring amino acid
  misc_feature (143)..(143): Xaa can be any naturally occurring amino acid
  misc_feature (174)..(174): Xaa can be any naturally occurring amino acid
  misc_feature (176)..(176): Xaa can be any naturally occurring amino acid
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGXPXFDYVTTLPPSRDELTKNQVSLTCLVXGFYPSDIAVEWESNGQPENNYKTTPPVLDSXGXFFLYSKLTVDKSRWQQGNVFSCSVMHEALHNHYGFSDLSLSPGK

SEQ ID NO: 105 - protein, 220 aa, Artificial Sequence
  Synthetic construct
  misc_feature (155)..(155): Xaa can be any naturally occurring amino acid
  misc_feature (157)..(158): Xaa can be any naturally occurring amino acid
  misc_feature (193)..(195): Xaa can be any naturally occurring amino acid
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDYVTTLPPSRDELTKNQVSLTCLVKGFYPSDIAVEWXSXXQPENNYKTTPPVLDSDGSFFLYSKLTVDKSRWQQXXXFSCSVMHEALHNHYGFSDLSLSPGK

SEQ ID NO: 106 - protein, 220 aa, Artificial Sequence
  Synthetic construct
  misc_feature (157)..(157): Xaa can be any naturally occurring amino acid
  misc_feature (159)..(163): Xaa can be any naturally occurring amino acid
  misc_feature (186)..(186): Xaa can be any naturally occurring amino acid
  misc_feature (189)..(189): Xaa can be any naturally occurring amino acid
  misc_feature (194)..(194): Xaa can be any naturally occurring amino acid
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESXGXXXXXYKTTPPVLDSDGSFFLYSKLTVXKSXWQQGXVFSCSVMHEALHNHYTQKSLSLSPGK

SEQ ID NO: 107 - protein, 181 aa, Homo sapiens
NSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVS

SEQ ID NO: 108 - protein, 181 aa, Macaca fascicularis
NSVIIVDKNGGLVYLVENPGGYVAYSKAATVTGKLVHANFGTKKDFEDLDSPVNGSIVIVRAGKITFAEKVANAESLNAIGVLIYMDQTKFPIVKADLSFFGHAHLGTGDPYTPGFPSFNHTQFPPSQSSGLPNIPVQTISRAAAEKLFGNMEGDCPSDWKTDSTCKMVTSENKSVKLTVS

SEQ ID NO: 109 - protein, 159 aa, Artificial Sequence
  Synthetic construct
SSGLPNIPVQTISRAAAEKLFGNMEGDCPSDWKTDSTCRMVTSESKNVKLTVSNDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSGP

SEQ ID NO: 110 - protein, 159 aa, Artificial Sequence
  Synthetic construct
SSGLPNIPVQTISRAAAEKLFGNMEGDCPSDWKTDSTCKMVTSENKSVKLTVSNDSAQNSVIIVDKNGGLVYLVENPGGYVAYSKAATVTGKLVHANFGTKKDFEDLDSPVNGSIVIVRAGKITFAEKVANAESLNAIGVLIYMDQTKFPIVKADLSGP

SEQ ID NO: 111 - protein, 5 aa, Artificial Sequence
  Synthetic construct
  misc_feature (4)..(4): Xaa can be any naturally occurring amino acid
VPPXM

SEQ ID NO: 112 - protein, 4 aa, Artificial Sequence
  Synthetic construct
SLTS

SEQ ID NO: 113 - protein, 12 aa, Artificial Sequence
  Synthetic construct
  misc_feature (4)..(4): Xaa can be any naturally occurring amino acid
  misc_feature (6)..(10): Xaa can be any naturally occurring amino acid
WESXGXXXXXYK

SEQ ID NO: 114 - protein, 12 aa, Artificial Sequence
  Synthetic construct
  misc_feature (3)..(3): Xaa can be any naturally occurring amino acid
  misc_feature (6)..(6): Xaa can be any naturally occurring amino acid
  misc_feature (11)..(11): Xaa can be any naturally occurring amino acid
TVXKSXWQQGXV

SEQ ID NO: 115 - protein, 5 aa, Artificial Sequence
  Synthetic construct
YGTEW

SEQ ID NO: 116 - protein, 7 aa, Artificial Sequence
  Synthetic construct
LGLVWVG

SEQ ID NO: 117 - protein, 7 aa, Artificial Sequence
  Synthetic construct
YGTVWSH

SEQ ID NO: 118 - protein, 7 aa, Artificial Sequence
  Synthetic construct
YGTEWSQ

SEQ ID NO: 119 - protein, 7 aa, Artificial Sequence
  Synthetic construct
VGTPWAL

SEQ ID NO: 120 - protein, 7 aa, Artificial Sequence
  Synthetic construct
YGTVWSK

SEQ ID NO: 121 - protein, 7 aa, Artificial Sequence
  Synthetic construct
LGHVWAV

SEQ ID NO: 122 - protein, 7 aa, Artificial Sequence
  Synthetic construct
MGHVWVG

SEQ ID NO: 123 - protein, 7 aa, Artificial Sequence
  Synthetic construct
LGLVGVF

SEQ ID NO: 124 - protein, 7 aa, Artificial Sequence
  Synthetic construct
YGTEWSS

SEQ ID NO: 125 - protein, 7 aa, Artificial Sequence
  Synthetic construct
YGTEWSN

SEQ ID NO: 126 - protein, 7 aa, Artificial Sequence
  Synthetic construct
LGHVWVG

SEQ ID NO: 127 - protein, 7 aa, Artificial Sequence
  Synthetic construct
LGHVWVA

SEQ ID NO: 128 - protein, 7 aa, Artificial Sequence
  Synthetic construct
LGPVWVH

SEQ ID NO: 129 - protein, 7 aa, Artificial Sequence
  Synthetic construct
LGHVWVD

SEQ ID NO: 130 - protein, 7 aa, Artificial Sequence
  Synthetic construct
LGHVWVN

SEQ ID NO: 131 - protein, 9 aa, Artificial Sequence
  Synthetic construct
AKSTWQQGW

SEQ ID NO: 132 - protein, 9 aa, Artificial Sequence
  Synthetic construct
SKSEWQQGY

SEQ ID NO: 133 - protein, 9 aa, Artificial Sequence
  Synthetic construct
EKSDWQQGH

SEQ ID NO: 134 - protein, 9 aa, Artificial Sequence
  Synthetic construct
LKSEWQQGW

SEQ ID NO: 135 - protein, 9 aa, Artificial Sequence
  Synthetic construct
SKSEWQQGF

SEQ ID NO: 136 - protein, 9 aa, Artificial Sequence
  Synthetic construct
PKSTWQQGW

SEQ ID NO: 137 - protein, 9 aa, Artificial Sequence
  Synthetic construct
DKSTWQQGW

SEQ ID NO: 138 - protein, 9 aa, Artificial Sequence
  Synthetic construct
TKSEWQQGF

SEQ ID NO: 139 - protein, 9 aa, Artificial Sequence
  Synthetic construct
SKSEWQQGW

SEQ ID NO: 140 - protein, 5 aa, Artificial Sequence
  Synthetic construct
FDYVT

SEQ ID NO: 141 - protein, 5 aa, Artificial Sequence
  Synthetic construct
FDMVT

SEQ ID NO: 142 - protein, 5 aa, Artificial Sequence
  Synthetic construct
FEYVT

SEQ ID NO: 143 - protein, 5 aa, Artificial Sequence
  Synthetic construct
FEMVT

SEQ ID NO: 144 - protein, 5 aa, Artificial Sequence
  Synthetic construct
FELVT

SEQ ID NO: 145 - protein, 5 aa, Artificial Sequence
  Synthetic construct
FEIVT

SEQ ID NO: 146 - protein, 5 aa, Artificial Sequence
  Synthetic construct
FDIVT

SEQ ID NO: 147 - protein, 5 aa, Artificial Sequence
  Synthetic construct
FGMVT

SEQ ID NO: 148 - protein, 5 aa, Artificial Sequence
  Synthetic construct
FADVT

SEQ ID NO: 149 - protein, 5 aa, Artificial Sequence
  Synthetic construct
FGLVT

SEQ ID NO: 150 - protein, 5 aa, Artificial Sequence
  Synthetic construct
IDYVT

SEQ ID NO: 151 - protein, 5 aa, Artificial Sequence
  Synthetic construct
FKDVT

SEQ ID NO: 152 - protein, 5 aa, Artificial Sequence
  Synthetic construct
FDLVT

SEQ ID NO: 153 - protein, 5 aa, Artificial Sequence
  Synthetic construct
FELVA

SEQ ID NO: 154 - protein, 4 aa, Artificial Sequence
  Synthetic construct
GHFD

SEQ ID NO: 155 - protein, 4 aa, Artificial Sequence
  Synthetic construct
GFYD

SEQ ID NO: 156 - protein, 4 aa, Artificial Sequence
  Synthetic construct
GFSD

SEQ ID NO: 157 - protein, 4 aa, Artificial Sequence
  Synthetic construct
GFFD

SEQ ID NO: 158 - protein, 3 aa, Artificial Sequence
  Synthetic construct
EFI

SEQ ID NO: 159 - protein, 3 aa, Artificial Sequence
  Synthetic construct
GFV

SEQ ID NO: 160 - protein, 3 aa, Artificial Sequence
  Synthetic construct
QFD

SEQ ID NO: 161 - protein, 3 aa, Artificial Sequence
  Synthetic construct
SFE

SEQ ID NO: 162 - protein, 3 aa, Artificial Sequence
  Synthetic construct
AFT

SEQ ID NO: 163 - protein, 3 aa, Artificial Sequence
  Synthetic construct
NFD

SEQ ID NO: 164 - protein, 3 aa, Artificial Sequence
  Synthetic construct
QFV

SEQ ID NO: 165 - protein, 3 aa, Artificial Sequence
  Synthetic construct
GFA

SEQ ID NO: 166 - protein, 3 aa, Artificial Sequence
  Synthetic construct
SFD

SEQ ID NO: 167 - protein, 3 aa, Artificial Sequence
  Synthetic construct
EFT

SEQ ID NO: 168 - protein, 3 aa, Artificial Sequence
  Synthetic construct
QFT

SEQ ID NO: 169 - protein, 3 aa, Artificial Sequence
  Synthetic construct
QFY

SEQ ID NO: 170 - protein, 3 aa, Artificial Sequence
  Synthetic construct
YFD

SEQ ID NO: 171 - protein, 3 aa, Artificial Sequence
  Synthetic construct
WFE

SEQ ID NO: 172 - protein, 8 aa, Artificial Sequence
  Synthetic construct
DVRYEWQL

SEQ ID NO: 173 - protein, 8 aa, Artificial Sequence
  Synthetic construct
PVSWEWYW

SEQ ID NO: 174 - protein, 8 aa, Artificial Sequence
  Synthetic construct
MVRREWHR

SEQ ID NO: 175 - protein, 8 aa, Artificial Sequence
  Synthetic construct
PVRWEWQW

SEQ ID NO: 176 - protein, 8 aa, Artificial Sequence
  Synthetic construct
PVRWEWQN

SEQ ID NO: 177 - protein, 8 aa, Artificial Sequence
  Synthetic construct
LVRREWHR

SEQ ID NO: 178 - protein, 8 aa, Artificial Sequence
  Synthetic construct
AVRWEWIR

SEQ ID NO: 179 - protein, 8 aa, Artificial Sequence
  Synthetic construct
EVAWEWFW

SEQ ID NO: 180 - protein, 8 aa, Artificial Sequence
  Synthetic construct
NVRVEWQY

SEQ ID NO: 181 - protein, 8 aa, Artificial Sequence
  Synthetic construct
EVRREWVR

SEQ ID NO: 182 - protein, 8 aa, Artificial Sequence
  Synthetic construct
LVRREWQR

SEQ ID NO: 183 - protein, 8 aa, Artificial Sequence
  Synthetic construct
DVRYEWYY

SEQ ID NO: 184 - protein, 8 aa, Artificial Sequence
  Synthetic construct
DVRYEWVR

SEQ ID NO: 185 - protein, 8 aa, Artificial Sequence
  Synthetic construct
NVRREWHR

SEQ ID NO: 186 - protein, 8 aa, Artificial Sequence
  Synthetic construct
FVGVAYDV

SEQ ID NO: 187 - protein, 6 aa, Artificial Sequence
  Synthetic construct
PQTPPW

SEQ ID NO: 188 - protein, 6 aa, Artificial Sequence
  Synthetic construct
PPSPPW

SEQ ID NO: 189 - protein, 6 aa, Artificial Sequence
  Synthetic construct
FRGPPW

SEQ ID NO: 190 - protein, 6 aa, Artificial Sequence
  Synthetic construct
PQTVPW

SEQ ID NO: 191 - protein, 6 aa, Artificial Sequence
  Synthetic construct
PKMPPW

SEQ ID NO: 192 - protein, 6 aa, Artificial Sequence
  Synthetic construct
PPVPPW

SEQ ID NO: 193 - protein, 6 aa, Artificial Sequence
  Synthetic construct
PAFPPW

SEQ ID NO: 194 - protein, 6 aa, Artificial Sequence
  Synthetic construct
AIWPPW

SEQ ID NO: 195 - protein, 6 aa, Artificial Sequence
  Synthetic construct
PPVAPW

SEQ ID NO: 196 - protein, 6 aa, Artificial Sequence
  Synthetic construct
PQMPPQ

SEQ ID NO: 197 - protein, 6 aa, Artificial Sequence
  Synthetic construct
PQTAPW

SEQ ID NO: 198 - protein, 6 aa, Artificial Sequence
  Synthetic construct
PQTPPQ

SEQ ID NO: 199 - protein, 6 aa, Artificial Sequence
  Synthetic construct
PRVPPW

SEQ ID NO: 200 - protein, 6 aa, Artificial Sequence
  Synthetic construct
PSVPPW

SEQ ID NO: 201 - protein, 6 aa, Artificial Sequence
  Synthetic construct
MLWPVP

SEQ ID NO: 202 - protein, 6 aa, Artificial Sequence
  Synthetic construct
MEWPVT

SEQ ID NO: 203 - protein, 6 aa, Artificial Sequence
  Synthetic construct
DDLTFQ

SEQ ID NO: 204 - protein, 6 aa, Artificial Sequence
  Synthetic construct
AYGDPE

SEQ ID NO: 205 - protein, 5 aa, Artificial Sequence
  Synthetic construct
EYYTY

SEQ ID NO: 206 - protein, 5 aa, Artificial Sequence
  Synthetic construct
EYYSN

SEQ ID NO: 207 - protein, 5 aa, Artificial Sequence
  Synthetic construct
EYYHD

SEQ ID NO: 208 - protein, 5 aa, Artificial Sequence
  Synthetic construct
EYYQN

SEQ ID NO: 209 - protein, 5 aa, Artificial Sequence
  Synthetic construct
EYYSS

SEQ ID NO: 210 - protein, 5 aa, Artificial Sequence
  Synthetic construct
VYHRP

SEQ ID NO: 211 - protein, 5 aa, Artificial Sequence
  Synthetic construct
TYHNP

SEQ ID NO: 212 - protein, 5 aa, Artificial Sequence
  Synthetic construct
TYHHP

SEQ ID NO: 213 - protein, 5 aa, Artificial Sequence
  Synthetic construct
VYVTP

SEQ ID NO: 214 - protein, 5 aa, Artificial Sequence
  Synthetic construct
LYVTP

SEQ ID NO: 215 - protein, 5 aa, Artificial Sequence
  Synthetic construct
WYDVP

SEQ ID NO: 216 - protein, 5 aa, Artificial Sequence
  Synthetic construct
VPPRM

SEQ ID NO: 217 - protein, 5 aa, Artificial Sequence
  Synthetic construct
VPPWM

SEQ ID NO: 218 - protein, 5 aa, Artificial Sequence
  Synthetic construct
DMWEY

SEQ ID NO: 219 - protein, 5 aa, Artificial Sequence
  Synthetic construct
DDWTW

SEQ ID NO: 220 - protein, 5 aa, Artificial Sequence
  Synthetic construct
DDWEW

SEQ ID NO: 221 - protein, 9 aa, Artificial Sequence
  Synthetic construct
LTSQHNSTV

SEQ ID NO: 222 - protein, 9 aa, Artificial Sequence
  Synthetic construct
WVKQLNSTW

SEQ ID NO: 223 - protein, 9 aa, Artificial Sequence
  Synthetic construct
WIAQPNSTW

SEQ ID NO: 224 - protein, 9 aa, Artificial Sequence
  Synthetic construct
WKLQLNSTW

SEQ ID NO: 225 - protein, 5 aa, Artificial Sequence
  Synthetic construct
WVWFY

SEQ ID NO: 226 - protein, 5 aa, Artificial Sequence
  Synthetic construct
VVGFR

SEQ ID NO: 227 - protein, 5 aa, Artificial Sequence
  Synthetic construct
IVGFR

SEQ ID NO: 228 - protein, 5 aa, Artificial Sequence
  Synthetic construct
AVGFE

SEQ ID NO: 229 - protein, 10 aa, Artificial Sequence
  Synthetic construct
SVVNIALWWS

SEQ ID NO: 230 - protein, 10 aa, Artificial Sequence
  Synthetic construct
RVSNSALTWK

SEQ ID NO: 231 - protein, 10 aa, Artificial Sequence
  Synthetic construct
RVSNSALSWR

SEQ ID NO: 232 - protein, 10 aa, Artificial Sequence
  Synthetic construct
RVSNSALRWR

SEQ ID NO: 233 - protein, 10 aa, Artificial Sequence
  Synthetic construct
QVFNWALDWV

SEQ ID NO: 234 - protein, 15 aa, Homo sapiens
EPKSCDKTHTCPPCP

SEQ ID NO: 235 - protein, 760 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 236 - protein, 220 aa, Artificial Sequence; identical to SEQ ID NO: 24
  Synthetic construct

SEQ ID NO: 237 - protein, 220 aa, Artificial Sequence; identical to SEQ ID NO: 25
  Synthetic construct

SEQ ID NO: 238 - protein, 220 aa, Artificial Sequence; identical to SEQ ID NO: 26
  Synthetic construct

SEQ ID NO: 239 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSNYKTTPPVLDSDGSFFLYSKLTVTKSEWQQGFVFSCSVMHEALHNHYTQKSLSLSPGK

SEQ ID NO: 240 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 241 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSNYKTTPPVLDSDGSFFLYSKLTVTKEEWQQGFVFSCSVMHEALHNHYTQKSLSLSPGK

SEQ ID NO: 242 - protein, 220 aa, Artificial Sequence; identical to SEQ ID NO: 21
  Synthetic construct

SEQ ID NO: 243 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESLGHVWAVYKTTPPVLDSDGSFFLYSKLTVPKSTWQQGWVFSCSVMHEALHNHYTQKSLSLSPGK

SEQ ID NO: 244 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVYWESLGHVWAVYKTTPPVLDSDGSFFLYSKLTVPKSTWQQGWVFSCSVMHEALHNHYTQKSLSLSPGK

SEQ ID NO: 245 - protein, 220 aa, Artificial Sequence; identical to SEQ ID NO: 22
  Synthetic construct

SEQ ID NO: 246 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWAVYFTTPPVLDSDGSFFLYSKLTVPKSTWQQGWVFSCSVMHEALHNHYTQKSLSLSPGK

SEQ ID NO: 247 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWAVYHTTPPVLDSDGSFFLYSKLTVPKSTWQQGWVFSCSVMHEALHNHYTQKSLSLSPGK

SEQ ID NO: 248 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYKTTPPVLDSDGSFFLYSKLTVTKSEWQQGFVFSCSVMHEALHNHYTQKSLSLSPGK

SEQ ID NO: 249 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTKSEWQQGFVFSCSVMHEALHNHYTQKSLSLSPGK

SEQ ID NO: 250 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFSCSVMHEALHNHYTQKSLSLSPGK

SEQ ID NO: 251 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTGEEWQQGFVFSCSVMHEALHNHYTQKSLSLSPGK

SEQ ID NO: 252 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFSCWVMHEALHNHYTQKSLSLSPGK

SEQ ID NO: 253 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTKEEWQQGFVFSCWVMHEALHNHYTQKSLSLSPGK

SEQ ID NO: 254 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFTCWVMHEALHNHYTQKSLSLSPGK

SEQ ID NO: 255 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFTCGVMHEALHNHYTQKSLSLSPGK

SEQ ID NO: 256 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFECWVMHEALHNHYTQKSLSLSPGK

SEQ ID NO: 257 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFKCWVMHEALHNHYTQKSLSLSPGK

SEQ ID NO: 258 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTPEEWQQGFVFKCWVMHEALHNHYTQKSLSLSPGK

SEQ ID NO: 259 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYRTTPPVLDSDGSFFLYSKLTVTREEWQQGFVFSCSVMHEALHNHYTQKSLSLSPGK

SEQ ID NO: 260 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYRTTPPVLDSDGSFFLYSKLTVTGEEWQQGFVFSCSVMHEALHNHYTQKSLSLSPGK

SEQ ID NO: 261 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYRTTPPVLDSDGSFFLYSKLTVTREEWQQGFVFTCWVMHEALHNHYTQKSLSLSPGK

SEQ ID NO: 262 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYRTTPPVLDSDGSFFLYSKLTVTGEEWQQGFVFTCWVMHEALHNHYTQKSLSLSPGK

SEQ ID NO: 263 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYRTTPPVLDSDGSFFLYSKLTVTREEWQQGFVFTCGVMHEALHNHYTQKSLSLSPGK

SEQ ID NO: 264 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYKTTPPVLDSDGSFFLYSKLTVTKEEWQQGFVFSCSVMHEALHNHYTQKSLSLSPGK

SEQ ID NO: 265 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTKEEWQQGFVFSCSVMHEALHNHYTQKSLSLSPGK

SEQ ID NO: 266 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 267 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWASYKTTPPVLDSDGSFFLYSKLTVTKEEWQQGFVFSCSVMHEALHNHYTQKSLSLSPGK

SEQ ID NO: 268 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWVSYKTTPPVLDSDGSFFLYSKLTVTKEEWQQGFVFSCSVMHEALHNHYTQKSLSLSPGK

SEQ ID NO: 269 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYKTTPPVLDSDGSFFLYSKLTVSKEEWQQGFVFSCSVMHEALHNHYTQKSLSLSPGK

SEQ ID NO: 270 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWASYKTTPPVLDSDGSFFLYSKLTVTKEEWQQGFVFSCSVMHEALHNHYTQKSLSLSPGK

SEQ ID NO: 271 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWVSYKTTPPVLDSDGSFFLYSKLTVTKEEWQQGFVFSCSVMHEALHNHYTQKSLSLSPGK

SEQ ID NO: 272 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWSSYKTTPPVLDSDGSFFLYSKLTVTKEEWQQGFVFSCSVMHEALHNHYTQKSLSLSPGK

SEQ ID NO: 273 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWASYKTTPPVLDSDGSFFLYSKLTVTKEEWQQGFVFSCSVMHEALHNHYTQKSLSLSPGK

SEQ ID NO: 274 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWVSYKTTPPVLDSDGSFFLYSKLTVTKEEWQQGFVFSCSVMHEALHNHYTQKSLSLSPGK

SEQ ID NO: 275 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYKTTPPVLDSDGSFFLYSKLTVSKEEWQQGFVFSCSVMHEALHNHYTQKSLSLSPGK

SEQ ID NO: 276 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWASYKTTPPVLDSDGSFFLYSKLTVTKEEWQQGFVFSCSVMHEALHNHYTQKSLSLSPGK

SEQ ID NO: 277 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWVSYKTTPPVLDSDGSFFLYSKLTVTKEEWQQGFVFSCSVMHEALHNHYTQKSLSLSPGK

SEQ ID NO: 278 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSNYKTTPPVLDSDGSFFLYSKLTVTKEEWQQGFVFSCSVMHEALHNHYTQKSLSLSPGK

SEQ ID NO: 279 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWANYKTTPPVLDSDGSFFLYSKLTVTKEEWQQGFVFSCSVMHEALHNHYTQKSLSLSPGK

SEQ ID NO: 280 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 281 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 282 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWANYKTTPPVLDSDGSFFLYSKLTVTKEEWQQGFVFSCSVMHEALHNHYTQKSLSLSPGK

SEQ ID NO: 283 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWVNYKTTPPVLDSDGSFFLYSKLTVTKEEWQQGFVFSCSVMHEALHNHYTQKSLSLSPGK

SEQ ID NO: 284 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWSNYKTTPPVLDSDGSFFLYSKLTVTKEEWQQGFVFSCSVMHEALHNHYTQKSLSLSPGK

SEQ ID NO: 285 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWANYKTTPPVLDSDGSFFLYSKLTVTKEEWQQGFVFSCSVMHEALHNHYTQKSLSLSPGK

SEQ ID NO: 286 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWVNYKTTPPVLDSDGSFFLYSKLTVTKEEWQQGFVFSCSVMHEALHNHYTQKSLSLSPGK

SEQ ID NO: 287 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSNYKTTPPVLDSDGSFFLYSKLTVSKEEWQQGFVFSCSVMHEALHNHYTQKSLSLSPGK

SEQ ID NO: 288 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWANYKTTPPVLDSDGSFFLYSKLTVTKEEWQQGFVFSCSVMHEALHNHYTQKSLSLSPGK

SEQ ID NO: 289 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWVNYKTTPPVLDSDGSFFLYSKLTVTKEEWQQGFVFSCSVMHEALHNHYTQKSLSLSPGK

SEQ ID NO: 290 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESFGTEWSSYKTTPPVLDSDGSFFLYSKLTVTKEEWQQGFVFSCSVMHEALHNHYTQKSLSLSPGK

SEQ ID NO: 291 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWASYKTTPPVLDSDGSFFLYSKLTVTKEEWQQGFVFSCSVMHEALHNHYTQKSLSLSPGK

SEQ ID NO: 292 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWVSYKTTPPVLDSDGSFFLYSKLTVTKEEWQQGFVFSCSVMHEALHNHYTQKSLSLSPGK

SEQ ID NO: 293 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYKTTPPVLDSDGSFFLYSKLTVSKEEWQQGFVFSCSVMHEALHNHYTQKSLSLSPGK

SEQ ID NO: 294 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESFGTEWASYKTTPPVLDSDGSFFLYSKLTVTKEEWQQGFVFSCSVMHEALHNHYTQKSLSLSPGK

SEQ ID NO: 295 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESFGTEWVSYKTTPPVLDSDGSFFLYSKLTVTKEEWQQGFVFSCSVMHEALHNHYTQKSLSLSPGK

SEQ ID NO: 296 - protein, 220 aa, Artificial Sequence; identical to SEQ ID NO: 27
  Synthetic construct

SEQ ID NO: 297 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESLGHVWVNQKTTPPVLDSDGSFFLYSKLTVPKSTWQQGWVFSCSVMHEALHNHYTQKSLSLSPGK

SEQ ID NO: 298 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVNQQTTPPVLDSDGSFFLYSKLTVPKSTWQQGWVFSCSVMHEALHNHYTQKSLSLSPGK

SEQ ID NO: 299 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESLGHVWVNQQTTPPVLDSDGSFFLYSKLTVPKSTWQQGWVFSCSVMHEALHNHYTQKSLSLSPGK

SEQ ID NO: 300 - protein, 760 aa, Macaca fascicularis
MMDQARSAFSNLFGGEPLSYTRFSLARQVDGDNSHVEMKLGVDEEENTDNNTKANGTKPKRCGGNICYGTIAVIIFFLIGFMIGYLGYCKGVEPKTECERLAGTESPAREEPEEDFPAAPRLYWDDLKRKLSEKLDTTDFTSTIKLLNENLYVPREAGSQKDENLALYIENQFREFKLSKVWRDQHFVKIQVKDSAQNSVIIVDKNGGLVYLVENPGGYVAYSKAATVTGKLVHANFGTKKDFEDLDSPVNGSIVIVRAGKITFAEKVANAESLNAIGVLIYMDQTKFPIVKADLSFFGHAHLGTGDPYTPGFPSFNHTQFPPSQSSGLPNIPVQTISRAAAEKLFGNMEGDCPSDWKTDSTCKMVTSENKSVKLTVSNVLKETKILNIFGVIKGFVEPDHYVVVGAQRDAWGPGAAKSSVGTALLLKLAQMFSDMVLKDGFQPSRSIIFASWSAGDFGSVGATEWLEGYLSSLHLKAFTYINLDKAVLGTSNFKVSASPLLYTLIEKTMQDVKHPVTGRSLYQDSNWASKVEKLTLDNAAFPFLAYSGIPAVSFCFCEDTDYPYLGTTMDTYKELVERIPELNKVARAAAEVAGQFVIKLTHDTELNLDYERYNSQLLLFLRDLNQYRADVKEMGLSLQWLYSARGDFFRATSRLTTDFRNAEKRDKFVMKKLNDRVMRVEYYFLSPYVSPKESPFRHVFWGSGSHTLSALLESLKLRRQNNSAFNETLFRNQLALATWTIQGAANALSGDVWDIDNEF

SEQ ID NO: 301 - protein, 186 aa, Artificial Sequence
  Synthetic construct
MGWSCIILFLVATATGAYAGTSSGLPNIPVQTISRAAAEKLFGNMEGDCPSDWKTDSTCRMVTSESKNVKLTVSNDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSASHHHHHH

SEQ ID NO: 302 - protein, 247 aa, Artificial Sequence
  Synthetic construct
METDTLLLWVLLLWVPGSTGDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESLGHVWAVYKTTPPVLDSDGSFFLYSKLTVPKSTWQQGWVFSCSVMHEALHNHYTQKSLSLSPGK

SEQ ID NO: 303 - protein, 11 aa, Artificial Sequence
  Synthetic construct
EWESFGTEWSS

SEQ ID NO: 304 - protein, 11 aa, Artificial Sequence
  Synthetic construct
EWESYGTEWAS

SEQ ID NO: 305 - protein, 11 aa, Artificial Sequence
  Synthetic construct
EWESYGTEWVS

SEQ ID NO: 306 - protein, 11 aa, Artificial Sequence
  Synthetic construct
EWESYGTEWSS

SEQ ID NO: 307 - protein, 11 aa, Artificial Sequence
  Synthetic construct
EWESFGTEWAS

SEQ ID NO: 308 - protein, 11 aa, Artificial Sequence
  Synthetic construct
EWESFGTEWVS

SEQ ID NO: 309 - protein, 11 aa, Artificial Sequence
  Synthetic construct
WWESFGTEWSS

SEQ ID NO: 310 - protein, 11 aa, Artificial Sequence
  Synthetic construct
WWESYGTEWAS

SEQ ID NO: 311 - protein, 11 aa, Artificial Sequence
  Synthetic construct
WWESYGTEWVS

SEQ ID NO: 312 - protein, 11 aa, Artificial Sequence
  Synthetic construct
WWESYGTEWSS

SEQ ID NO: 313 - protein, 11 aa, Artificial Sequence
  Synthetic construct
WWESFGTEWAS

SEQ ID NO: 314 - protein, 11 aa, Artificial Sequence
  Synthetic construct
WWESFGTEWVS

SEQ ID NO: 315 - protein, 11 aa, Artificial Sequence
  Synthetic construct
EWESFGTEWSN

SEQ ID NO: 316 - protein, 11 aa, Artificial Sequence
  Synthetic construct
EWESYGTEWAN

SEQ ID NO: 317 - protein, 11 aa, Artificial Sequence
  Synthetic construct
EWESYGTEWVN

SEQ ID NO: 318 - protein, 11 aa, Artificial Sequence
  Synthetic construct
EWESYGTEWSN

SEQ ID NO: 319 - protein, 11 aa, Artificial Sequence
  Synthetic construct
EWESFGTEWAN

SEQ ID NO: 320 - protein, 11 aa, Artificial Sequence
  Synthetic construct
EWESFGTEWVN

SEQ ID NO: 321 - protein, 11 aa, Artificial Sequence
  Synthetic construct
WWESFGTEWSN

SEQ ID NO: 322 - protein, 11 aa, Artificial Sequence
  Synthetic construct
WWESYGTEWAN

SEQ ID NO: 323 - protein, 11 aa, Artificial Sequence
  Synthetic construct
WWESYGTEWVN

SEQ ID NO: 324 - protein, 11 aa, Artificial Sequence
  Synthetic construct
WWESYGTEWSN

SEQ ID NO: 325 - protein, 11 aa, Artificial Sequence
  Synthetic construct
WWESFGTEWAN

SEQ ID NO: 326 - protein, 11 aa, Artificial Sequence
  Synthetic construct
WWESFGTEWVN

SEQ ID NO: 327 - protein, 11 aa, Artificial Sequence
  Synthetic construct
LWESFGTEWSS

SEQ ID NO: 328 - protein, 11 aa, Artificial Sequence
  Synthetic construct
LWESYGTEWAS

SEQ ID NO: 329 - protein, 11 aa, Artificial Sequence
  Synthetic construct
LWESYGTEWVS

SEQ ID NO: 330 - protein, 11 aa, Artificial Sequence
  Synthetic construct
LWESYGTEWSS

SEQ ID NO: 331 - protein, 11 aa, Artificial Sequence
  Synthetic construct
LWESFGTEWAS

SEQ ID NO: 332 - protein, 11 aa, Artificial Sequence
  Synthetic construct
LWESFGTEWVS

SEQ ID NO: 333 - protein, 11 aa, Artificial Sequence
  Synthetic construct
WWESLGHVWAV

SEQ ID NO: 334 - protein, 11 aa, Artificial Sequence
  Synthetic construct
EWESLGHVWAV

SEQ ID NO: 335 - protein, 11 aa, Artificial Sequence
  Synthetic construct
LWESLGHVWAV

SEQ ID NO: 336 - protein, 11 aa, Artificial Sequence
  Synthetic construct
YWESLGHVWAV

SEQ ID NO: 337 - protein, 11 aa, Artificial Sequence
  Synthetic construct
EWESLGLVWVF

SEQ ID NO: 338 - protein, 11 aa, Artificial Sequence
  Synthetic construct
WWESLGHVWVN

SEQ ID NO: 339 - protein, 11 aa, Artificial Sequence
  Synthetic construct
EWESLGHVWVN

SEQ ID NO: 340 - protein, 9 aa, Artificial Sequence
  Synthetic construct
TKEEWQQGF

SEQ ID NO: 341 - protein, 9 aa, Artificial Sequence
  Synthetic construct
SKEEWQQGF

SEQ ID NO: 342 - protein, 9 aa, Artificial Sequence
  Synthetic construct
PKTSWQQGW

SEQ ID NO: 343 - protein, 9 aa, Artificial Sequence
  Synthetic construct
TREEWQQGF

SEQ ID NO: 344 - protein, 9 aa, Artificial Sequence
  Synthetic construct
TPEEWQQGF

SEQ ID NO: 345 - protein, 9 aa, Artificial Sequence
  Synthetic construct
TGEEWQQGF

SEQ ID NO: 346 - protein, 12 aa, Artificial Sequence
  Synthetic construct
  misc_feature (3)..(3): Xaa can be any naturally occurring amino acid
  misc_feature (5)..(6): Xaa can be any naturally occurring amino acid
  misc_feature (11)..(11): Xaa can be any naturally occurring amino acid
TVXKXXWQQGXV

SEQ ID NO: 347 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESYGTEWSSYKTTPPVLDSDGSFFLYSKLTVTKEEWQQGFVFSCSVMHEALHNHYTQKSLSLSPGK

SEQ ID NO: 348 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 349 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 350 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 351 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 352 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 353 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 354 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 355 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 356 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 357 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 358 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 359 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 360 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 361 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 362 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 363 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 364 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 365 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 366 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 367 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 368 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 369 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 370 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 371 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 372 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 373 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 374 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 375 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 376 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 377 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 378 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 379 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 380 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 381 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 382 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 383 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 384 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 385 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 386 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 387 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 388 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 389 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 390 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 391 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 392 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 393 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 394 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 395 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 396 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 397 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 398 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 399 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 400 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 401 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 402 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 403 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 404 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 405 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 406 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 407 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 408 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 409 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 410 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 411 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 412 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 413 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 414 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 415 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 416 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 417 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 418 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 419 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 420 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 421 - protein, 247 aa, Artificial Sequence
  Synthetic construct
METDTLLLWVLLLWVPGSTGDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESYGTEWSSYKTTPPVLDSDGSFFLYSKLTVTKSEWQQGFVFSCSVMHEALHNHYTQKSLSLSPGK

SEQ ID NO: 422 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESWGFVWSTYKTTPPVLDSDGSFFLYSKLTVPKSNWQQGFVFSCSVMHEALHNHYTQKSLSLSPGK

SEQ ID NO: 423 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESWGHVWSTYKTTPPVLDSDGSFFLYSKLTVPKSNWQQGYVFSCSVMHEALHNHYTQKSLSLSPGK

SEQ ID NO: 424 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVEQKTTPPVLDSDGSFFLYSKLTVPKSTWQQGWVFSCSVMHEALHNHYTQKSLSLSPGK

SEQ ID NO: 425 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVGVKTTPPVLDSDGSFFLYSKLTVPKSTWQQGWVFSCSVMHEALHNHYTQKSLSLSPGK

SEQ ID NO: 426 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVHTKTTPPVLDSDGSFFLYSKLTVPKSTWQQGWVFSCSVMHEALHNHYTQKSLSLSPGK

SEQ ID NO: 427 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESWGTVWGTYKTTPPVLDSDGSFFLYSKLTVPKSNWQQGYVFSCSVMHEALHNHYTQKSLSLSPGK

SEQ ID NO: 428 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVGTKTTPPVLDSDGSFFLYSKLTVPKSTWQQGWVFSCSVMHEALHNHYTQKSLSLSPGK

SEQ ID NO: 429 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 430 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWANYKTTPPVLDSDGSFFLYSKLTVSKSEWQQGFVFSCSVMHEALHNHYTQKSLSLSPGK

SEQ ID NO: 431 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 432 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYKTTPPVLDSDGSFFLYSKLTVSKSEWQQGFVFSCSVMHEALHNHYTQKSLSLSPGK

SEQ ID NO: 433 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWVNYKTTPPVLDSDGSFFLYSKLTVSKEEWQQGFVFSCSVMHEALHNHYTQKSLSLSPGK

SEQ ID NO: 434 - protein, 220 aa, Artificial Sequence; identical to SEQ ID NO: 14
  Synthetic construct

SEQ ID NO: 435 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWVNYKTTPPVLDSDGSFFLYSKLTVSKEEWQQGFVFSCSVMHEALHNHYTQKSLSLSPGK

SEQ ID NO: 436 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 437 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 438 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 439 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 440 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 441 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 442 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 443 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 444 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 445 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 446 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 447 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 448 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 449 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 450 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 451 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 452 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 453 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 454 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 455 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 456 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 457 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 458 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 459 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 460 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 461 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 462 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 463 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 464 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 465 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 466 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 467 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 468 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 469 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 470 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 471 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 472 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 473 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 474 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 475 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 476 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 477 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 478 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 479 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 480 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 481 - protein, 220 aa, Artificial Sequence
  Synthetic construct
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 482 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 483 - protein, 220 aa, Artificial Sequence
  Synthetic construct
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 484 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSSYKTTPPVLDSDGSFFLYSKLTVTKEEWQQGFVFSCSVLHEALHSHYTQKSLSLSPGK

SEQ ID NO: 485 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVLHEALHSHYTQKSLSLSPGK

SEQ ID NO: 486 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVLHEALHSHYTQKSLSLSPGK

SEQ ID NO: 487 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVLHEALHSHYTQKSLSLSPGK

SEQ ID NO: 488 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVLHEALHSHYTQKSLSLSPGK

SEQ ID NO: 489 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVLHEALHSHYTQKSLSLSPGK

SEQ ID NO: 490 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVLHEALHSHYTQKSLSLSPGK

SEQ ID NO: 491 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWANYKTTPPVLDSDGSFFLYSKLTVTKEEWQQGFVFSCSVLHEALHSHYTQKSLSLSPGK

SEQ ID NO: 492 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVLHEALHSHYTQKSLSLSPGK

SEQ ID NO: 493 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVLHEALHSHYTQKSLSLSPGK

SEQ ID NO: 494 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVLHEALHSHYTQKSLSLSPGK

SEQ ID NO: 495 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVLHEALHSHYTQKSLSLSPGK

SEQ ID NO: 496 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVLHEALHSHYTQKSLSLSPGK

SEQ ID NO: 497 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVLHEALHSHYTQKSLSLSPGK

SEQ ID NO: 498 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWVNYKTTPPVLDSDGSFFLYSKLTVTKEEWQQGFVFSCSVLHEALHSHYTQKSLSLSPGK

SEQ ID NO: 499 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVLHEALHSHYTQKSLSLSPGK

SEQ ID NO: 500 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVLHEALHSHYTQKSLSLSPGK

SEQ ID NO: 501 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVLHEALHSHYTQKSLSLSPGK

SEQ ID NO: 502 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVLHEALHSHYTQKSLSLSPGK

SEQ ID NO: 503 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVLHEALHSHYTQKSLSLSPGK

SEQ ID NO: 504 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVLHEALHSHYTQKSLSLSPGK

SEQ ID NO: 505 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVSKEEWQQGFVFSCSVLHEALHSHYTQKSLSLSPGK

SEQ ID NO: 506 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVLHEALHSHYTQKSLSLSPGK

SEQ ID NO: 507 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVLHEALHSHYTQKSLSLSPGK

SEQ ID NO: 508 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVLHEALHSHYTQKSLSLSPGK

SEQ ID NO: 509 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVLHEALHSHYTQKSLSLSPGK

SEQ ID NO: 510 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVLHEALHSHYTQKSLSLSPGK

SEQ ID NO: 511 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVLHEALHSHYTQKSLSLSPGK

SEQ ID NO: 512 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWASYKTTPPVLDSDGSFFLYSKLTVTKEEWQQGFVFSCSVLHEALHSHYTQKSLSLSPGK

SEQ ID NO: 513 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVLHEALHSHYTQKSLSLSPGK

SEQ ID NO: 514 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVLHEALHSHYTQKSLSLSPGK

SEQ ID NO: 515 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVLHEALHSHYTQKSLSLSPGK

SEQ ID NO: 516 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVLHEALHSHYTQKSLSLSPGK

SEQ ID NO: 517 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVLHEALHSHYTQKSLSLSPGK

SEQ ID NO: 518 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVLHEALHSHYTQKSLSLSPGK

SEQ ID NO: 519 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVTKEEWQQGFVFSCSVLHEALHSHYTQKSLSLSPGK

SEQ ID NO: 520 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVLHEALHSHYTQKSLSLSPGK

SEQ ID NO: 521 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVLHEALHSHYTQKSLSLSPGK

SEQ ID NO: 522 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVLHEALHSHYTQKSLSLSPGK

SEQ ID NO: 523 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVLHEALHSHYTQKSLSLSPGK

SEQ ID NO: 524 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVLHEALHSHYTQKSLSLSPGK

SEQ ID NO: 525 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVLHEALHSHYTQKSLSLSPGK

SEQ ID NO: 526 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYKTTPPVLDSDGSFFLYSKLTVTKEEWQQGFVFSCSVLHEALHSHYTQKSLSLSPGK

SEQ ID NO: 527 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVLHEALHSHYTQKSLSLSPGK

SEQ ID NO: 528 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVLHEALHSHYTQKSLSLSPGK

SEQ ID NO: 529 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVLHEALHSHYTQKSLSLSPGK

SEQ ID NO: 530 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVLHEALHSHYTQKSLSLSPGK

SEQ ID NO: 531 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVLHEALHSHYTQKSLSLSPGK

SEQ ID NO: 532 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVLHEALHSHYTQKSLSLSPGK

SEQ ID NO: 533 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSSYKTTPPVLDSDGSFFLYSKLTVSKEEWQQGFVFSCSVLHEALHSHYTQKSLSLSPGK

SEQ ID NO: 534 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVLHEALHSHYTQKSLSLSPGK

SEQ ID NO: 535 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVLHEALHSHYTQKSLSLSPGK

SEQ ID NO: 536 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVLHEALHSHYTQKSLSLSPGK

SEQ ID NO: 537 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVLHEALHSHYTQKSLSLSPGK

SEQ ID NO: 538 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVLHEALHSHYTQKSLSLSPGK

SEQ ID NO: 539 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVLHEALHSHYTQKSLSLSPGK

SEQ ID NO: 540 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWANYKTTPPVLDSDGSFFLYSKLTVSKSEWQQGFVFSCSVLHEALHSHYTQKSLSLSPGK

SEQ ID NO: 541 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVLHEALHSHYTQKSLSLSPGK

SEQ ID NO: 542 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVLHEALHSHYTQKSLSLSPGK

SEQ ID NO: 543 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVLHEALHSHYTQKSLSLSPGK

SEQ ID NO: 544 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVLHEALHSHYTQKSLSLSPGK

SEQ ID NO: 545 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVLHEALHSHYTQKSLSLSPGK

SEQ ID NO: 546 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVLHEALHSHYTQKSLSLSPGK

SEQ ID NO: 547 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSNYKTTPPVLDSDGSFFLYSKLTVSKEEWQQGFVFSCSVLHEALHSHYTQKSLSLSPGK

SEQ ID NO: 548 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVLHEALHSHYTQKSLSLSPGK

SEQ ID NO: 549 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVLHEALHSHYTQKSLSLSPGK

SEQ ID NO: 550 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVLHEALHSHYTQKSLSLSPGK

SEQ ID NO: 551 - protein, 220 aa, Artificial Sequence
  Synthetic construct
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVLHEALHSHYTQKSLSLSPGK

SEQ ID NO: 552 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVLHEALHSHYTQKSLSLSPGK

SEQ ID NO: 553 - protein, 220 aa, Artificial Sequence
  Synthetic construct
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVLHEALHSHYTQKSLSLSPGK

SEQ ID NO: 554 - protein, 11 aa, Artificial Sequence
  Synthetic construct
  MISC_FEATURE (1)..(1): Xaa = Glu, Leu, Ser, Val, Trp, or Tyr
  MISC_FEATURE (5)..(5): Xaa = an aromatic amino acid (e.g., Tyr, Phe, or Trp), Met, Pro, or Val
  MISC_FEATURE (7)..(7): Xaa = Thr, Asn, or Val
  MISC_FEATURE (8)..(8): Xaa = Glu, Ile, Pro, or Val
  MISC_FEATURE (10)..(10): Xaa = an aliphatic amino acid (e.g., Ala, Ile, or Val), Ser, or Thr
  MISC_FEATURE (11)..(11): Xaa = Ser, Asn, Arg, or Thr
XWESXGXXWXX

SEQ ID NO: 555 - protein, 14 aa, Artificial Sequence
  Synthetic construct
  MISC_FEATURE (1)..(1): Xaa = Thr, His, or Ser
  MISC_FEATURE (3)..(3): Xaa = Glu, Ser, Asp, Gly, Thr, Pro, Gln, or Arg
  MISC_FEATURE (4)..(4): Xaa = Glu or Arg
  MISC_FEATURE (9)..(9): Xaa = Phe, His, Lys, Tyr, or Trp
  MISC_FEATURE (12)..(12): Xaa = Ser, Thr, or Trp
  MISC_FEATURE (14)..(14): Xaa = Ser, Cys, Pro, Met, or Trp
XKXXWQQGXVFXCX

SEQ ID NO: 556 - protein, 107 aa, Artificial Sequence
  Synthetic construct
  MISC_FEATURE (40)..(40): Xaa = Glu, Leu, Ser, Val, Trp, or Tyr
  MISC_FEATURE (44)..(44): Xaa = an aromatic amino acid (e.g., Tyr, Phe, or Trp), Met, Pro, or Val
  MISC_FEATURE (46)..(46): Xaa = Thr, Asn, or Val
  MISC_FEATURE (47)..(47): Xaa = Glu, Ile, Pro, or Val
  MISC_FEATURE (49)..(49): Xaa = an aliphatic amino acid (e.g., Ala, Ile, or Val), Ser, or Thr
  MISC_FEATURE (50)..(50): Xaa = Ser, Asn, Arg, or Thr
  MISC_FEATURE (73)..(73): Xaa = Thr, His, or Ser
  MISC_FEATURE (75)..(75): Xaa = Glu, Ser, Asp, Gly, Thr, Pro, Gln, or Arg
  MISC_FEATURE (76)..(76): Xaa = Glu or Arg
  MISC_FEATURE (81)..(81): Xaa = Phe, His, Lys, Tyr, or Trp
  MISC_FEATURE (84)..(84): Xaa = Ser, Thr, or Trp
  MISC_FEATURE (86)..(86): Xaa = Ser, Cys, Pro, Met, or Trp
GQPREPQVYTLPPSRDELTKNQVSLTCLVKGFYPSDIAVXWESXGXXWXXYKTTPPVLDSDGSFFLYSKLTVXKXXWQQGXVFXCXVMHEALHNHYTQKSLSLSPGK

SEQ ID NO: 557 - protein, 11 aa, Artificial Sequence
  Synthetic construct
  MISC_FEATURE (1)..(1): Xaa = Glu, Leu, or Trp
  MISC_FEATURE (5)..(5): Xaa = an aromatic amino acid (e.g., Tyr or Phe)
  MISC_FEATURE (10)..(10): Xaa = an aliphatic amino acid (e.g., Ala or Val) or Ser
  MISC_FEATURE (11)..(11): Xaa = Ser or Asn
XWESXGTEWXX

SEQ ID NO: 558 - protein, 14 aa, Artificial Sequence
  Synthetic construct
  MISC_FEATURE (1)..(1): Xaa = Thr or Ser
  MISC_FEATURE (3)..(3): Xaa = Glu or Ser
  MISC_FEATURE (9)..(9): Xaa = Phe, His, Tyr, or Trp
XKXEWQQGXVFSCS

SEQ ID NO: 559 - protein, 107 aa, Artificial Sequence
  Synthetic construct
  MISC_FEATURE (40)..(40): Xaa = Glu, Leu, or Trp
  MISC_FEATURE (44)..(44): Xaa = an aromatic amino acid (e.g., Tyr or Phe)
  MISC_FEATURE (49)..(49): Xaa = an aliphatic amino acid (e.g., Ala or Val) or Ser
  MISC_FEATURE (50)..(50): Xaa = Ser or Asn
  MISC_FEATURE (73)..(73): Xaa = Thr or Ser
  MISC_FEATURE (75)..(75): Xaa = Glu or Ser
  MISC_FEATURE (81)..(81): Xaa = Phe, His, Tyr, or Trp
GQPREPQVYTLPPSRDELTKNQVSLTCLVKGFYPSDIAVXWESXGTEWXXYKTTPPVLDSDGSFFLYSKLTVXKXEWQQGXVFSCSVMHEALHNHYTQKSLSLSPGK

SEQ ID NO: 560 - protein, 11 aa, Artificial Sequence
  Synthetic construct
  MISC_FEATURE (1)..(1): Xaa = Glu, Leu, or Trp
  MISC_FEATURE (5)..(5): Xaa = Tyr or Phe
  MISC_FEATURE (10)..(10): Xaa = Ser, Ala or Val
  MISC_FEATURE (11)..(11): Xaa = Ser or Asn
XWESXGTEWXX

SEQ ID NO: 561 - protein, 14 aa, Artificial Sequence
  Synthetic construct
  MISC_FEATURE (1)..(1): Xaa = Thr or Ser
  MISC_FEATURE (3)..(3): Xaa = Glu or Ser
XKXEWQQGFVFSCS

SEQ ID NO: 562 - protein, 107 aa, Artificial Sequence
  Synthetic construct
  MISC_FEATURE (40)..(40): Xaa = Glu, Leu, or Trp
  MISC_FEATURE (44)..(44): Xaa = Tyr or Phe
  MISC_FEATURE (49)..(49): Xaa = Ser, Ala or Val
  MISC_FEATURE (50)..(50): Xaa = Ser or Asn
  MISC_FEATURE (73)..(73): Xaa = Thr or Ser
  MISC_FEATURE (75)..(75): Xaa = Glu or Ser
GQPREPQVYTLPPSRDELTKNQVSLTCLVKGFYPSDIAVXWESXGTEWXXYKTTPPVLDSDGSFFLYSKLTVXKXEWQQGFVFSCSVMHEALHNHYTQKSLSLSPGK

SEQ ID NO: 563 - protein, 107 aa, Artificial Sequence
  Synthetic construct
  MISC_FEATURE (40)..(40): Xaa = Glu, Leu, Ser, Val, Trp, or Tyr
GQPREPQVYTLPPSRDELTKNQVSLTCLVKGFYPSDIAVXWESYGTEWSSYKTTPPVLDSDGSFFLYSKLTVTKEEWQQGFVFSCSVMHEALHNHYTQKSLSLSPGK

SEQ ID NO: 564 - protein, 107 aa, Artificial Sequence
  Synthetic construct
  MISC_FEATURE (44)..(44): Xaa = Tyr, Phe, Met, Pro, Val, or Trp
GQPREPQVYTLPPSRDELTKNQVSLTCLVKGFYPSDIAVWWESXGTEWSSYKTTPPVLDSDGSFFLYSKLTVTKEEWQQGFVFSCSVMHEALHNHYTQKSLSLSPGK

SEQ ID NO: 565 - protein, 107 aa, Artificial Sequence
  Synthetic construct
  MISC_FEATURE (46)..(46): Xaa = Thr, Asn, or Val
GQPREPQVYTLPPSRDELTKNQVSLTCLVKGFYPSDIAVWWESYGXEWSSYKTTPPVLDSDGSFFLYSKLTVTKEEWQQGFVFSCSVMHEALHNHYTQKSLSLSPGK

SEQ ID NO: 566 - protein, 107 aa, Artificial Sequence
  Synthetic construct
  MISC_FEATURE (47)..(47): Xaa = Glu, Ile, Pro, or Val
GQPREPQVYTLPPSRDELTKNQVSLTCLVKGFYPSDIAVWWESYGTXWSSYKTTPPVLDSDGSFFLYSKLTVTKEEWQQGFVFSCSVMHEALHNHYTQKSLSLSPGK

SEQ ID NO: 567 - protein, 107 aa, Artificial Sequence
  Synthetic construct
  MISC_FEATURE (49)..(49): Xaa = Ser, Ala, Ile, Thr, or Val
GQPREPQVYTLPPSRDELTKNQVSLTCLVKGFYPSDIAVWWESYGTEWXSYKTTPPVLDSDGSFFLYSKLTVTKEEWQQGFVFSCSVMHEALHNHYTQKSLSLSPGK

SEQ ID NO: 568 - protein, 107 aa, Artificial Sequence
  Synthetic construct
  MISC_FEATURE (50)..(50): Xaa = Ser, Asn, Arg, or Thr
GQPREPQVYTLPPSRDELTKNQVSLTCLVKGFYPSDIAVWWESYGTEWSXYKTTPPVLDSDGSFFLYSKLTVTKEEWQQGFVFSCSVMHEALHNHYTQKSLSLSPGK

SEQ ID NO: 569 - protein, 107 aa, Artificial Sequence
  Synthetic construct
  MISC_FEATURE (73)..(73): Xaa = Thr, His, or Ser
GQPREPQVYTLPPSRDELTKNQVSLTCLVKGFYPSDIAVWWESYGTEWSSYKTTPPVLDSDGSFFLYSKLTVXKEEWQQGFVFSCSVMHEALHNHYTQKSLSLSPGK

SEQ ID NO: 570 - protein, 107 aa, Artificial Sequence
  Synthetic construct
  MISC_FEATURE (75)..(75): Xaa = Glu, Ser, Asp, Gly, Thr, Pro, Gln, or Arg
GQPREPQVYTLPPSRDELTKNQVSLTCLVKGFYPSDIAVWWESYGTEWSSYKTTPPVLDSDGSFFLYSKLTVTKXEWQQGFVFSCSVMHEALHNHYTQKSLSLSPGK

SEQ ID NO: 571 - protein, 107 aa, Artificial Sequence
  Synthetic construct
  MISC_FEATURE (76)..(76): Xaa = Glu or Arg
GQPREPQVYTLPPSRDELTKNQVSLTCLVKGFYPSDIAVWWESYGTEWSSYKTTPPVLDSDGSFFLYSKLTVTKEXWQQGFVFSCSVMHEALHNHYTQKSLSLSPGK

SEQ ID NO: 572 - protein, 107 aa, Artificial Sequence
  Synthetic construct
  MISC_FEATURE (81)..(81): Xaa = Phe, His, Lys, or Tyr
GQPREPQVYTLPPSRDELTKNQVSLTCLVKGFYPSDIAVWWESYGTEWSSYKTTPPVLDSDGSFFLYSKLTVTKEEWQQGXVFSCSVMHEALHNHYTQKSLSLSPGK

SEQ ID NO: 573 - protein, 107 aa, Artificial Sequence
  Synthetic construct
  MISC_FEATURE (84)..(84): Xaa = Ser, Thr, or Trp
GQPREPQVYTLPPSRDELTKNQVSLTCLVKGFYPSDIAVWWESYGTEWSSYKTTPPVLDSDGSFFLYSKLTVTKEEWQQGFVFXCSVMHEALHNHYTQKSLSLSPGK

SEQ ID NO: 574 - protein, 107 aa, Artificial Sequence
  Synthetic construct
  MISC_FEATURE (86)..(86): Xaa = Ser, Cys, Pro, Met, or Trp
GQPREPQVYTLPPSRDELTKNQVSLTCLVKGFYPSDIAVWWESYGTEWSSYKTTPPVLDSDGSFFLYSKLTVTKEEWQQGFVFSCXVMHEALHNHYTQKSLSLSPGK

SEQ ID NO: 575 - protein, 12 aa, Artificial Sequence
  Synthetic construct
  MISC_FEATURE (1)..(1): Xaa = Glu or Trp
  MISC_FEATURE (5)..(5): Xaa = Val, Trp, Leu, or Tyr
  MISC_FEATURE (7)..(7): Xaa = Leu, Pro, Phe, Thr, or His
  MISC_FEATURE (8)..(8): Xaa = Pro, Val, or Glu
  MISC_FEATURE (10)..(10): Xaa = Ala, Ser, Val, or Gly
  MISC_FEATURE (11)..(11): Xaa = Leu, His, Gln, Gly, Val, Ala, Asn, Asp, Thr, or Glu
  MISC_FEATURE (12)..(12): Xaa = Thr, Phe, Gln, Val, or Tyr
XWESXGXXWXXX

SEQ ID NO: 576 - protein, 9 aa, Artificial Sequence
  Synthetic construct
  MISC_FEATURE (1)..(1): Xaa = Leu, Ser, Glu, Ala, or Pro
  MISC_FEATURE (4)..(4): Xaa = Glu, Asp, Thr, or Asn
  MISC_FEATURE (9)..(9): Xaa = Trp, Tyr, His, or Phe
XKSXWQQGX

SEQ ID NO: 577 - protein, 107 aa, Artificial Sequence
  Synthetic construct
  MISC_FEATURE (40)..(40): Xaa = Glu or Trp
  MISC_FEATURE (44)..(44): Xaa = Val, Trp, Leu, or Tyr
  MISC_FEATURE (46)..(46): Xaa = Leu, Pro, Phe, Thr, or His
  MISC_FEATURE (47)..(47): Xaa = Pro, Val, or Glu
  MISC_FEATURE (49)..(49): Xaa = Ala, Ser, Val, or Gly
  MISC_FEATURE (50)..(50): Xaa = Leu, His, Gln, Gly, Val, Ala, Asn, Asp, Thr, or Glu
  MISC_FEATURE (51)..(51): Xaa = Thr, Phe, Gln, Val, or Tyr
  MISC_FEATURE (73)..(73): Xaa = Leu, Ser, Glu, Ala, or Pro
  MISC_FEATURE (76)..(76): Xaa = Glu, Asp, Thr, or Asn
  MISC_FEATURE (81)..(81): Xaa = Trp, Tyr, His, or Phe
GQPREPQVYTLPPSRDELTKNQVSLTCLVKGFYPSDIAVXWESXGXXWXXXKTTPPVLDSDGSFFLYSKLTVXKSXWQQGXVFSCSVMHEALHNHYTQKSLSLSPGK

SEQ ID NO: 578 - protein, 12 aa, Artificial Sequence
  Synthetic construct
  MISC_FEATURE (1)..(1): Xaa = Glu or Trp
  MISC_FEATURE (5)..(5): Xaa = Trp, Leu, or Tyr
  MISC_FEATURE (7)..(7): Xaa = Thr or His
  MISC_FEATURE (10)..(10): Xaa = Ala, Ser, or Val
  MISC_FEATURE (11)..(11): Xaa = Val, Thr, or Asn
  MISC_FEATURE (12)..(12): Xaa = Tyr or Gln
XWESXGXVWXXX

SEQ ID NO: 579 - protein, 9 aa, Artificial Sequence
  Synthetic construct
  MISC_FEATURE (4)..(4): Xaa = Thr or Asn
  MISC_FEATURE (9)..(9): Xaa = Trp, Tyr, His, or Phe
PKSXWQQGX

SEQ ID NO: 580 - protein, 107 aa, Artificial Sequence
  Synthetic construct
  MISC_FEATURE (40)..(40): Xaa = Glu or Trp
  MISC_FEATURE (44)..(44): Xaa = Trp, Leu, or Tyr
  MISC_FEATURE (46)..(46): Xaa = Thr or His
  MISC_FEATURE (49)..(49): Xaa = Ala, Ser, or Val
  MISC_FEATURE (50)..(50): Xaa = Val, Thr, or Asn
  MISC_FEATURE (51)..(51): Xaa = Tyr or Gln
  MISC_FEATURE (76)..(76): Xaa = Thr or Asn
  MISC_FEATURE (81)..(81): Xaa = Trp, Tyr, His, or Phe
GQPREPQVYTLPPSRDELTKNQVSLTCLVKGFYPSDIAVXWESXGXVWXXXKTTPPVLDSDGSFFLYSKLTVPKSXWQQGXVFSCSVMHEALHNHYTQKSLSLSPGK

SEQ ID NO: 581 - protein, 11 aa, Artificial Sequence
  Synthetic construct
EWESFGTEWSS

SEQ ID NO: 582 - protein, 9 aa, Artificial Sequence
  Synthetic construct
SKEEWQQGF

SEQ ID NO: 583 - protein, 11 aa, Artificial Sequence
  Synthetic construct
EWESYGTEWAN

SEQ ID NO: 584 - protein, 9 aa, Artificial Sequence
  Synthetic construct
SKSEWQQGF

SEQ ID NO: 585 - protein, 11 aa, Artificial Sequence
  Synthetic construct
EWESFGTEWSN

SEQ ID NO: 586 - protein, 9 aa, Artificial Sequence
  Synthetic construct
SKEEWQQGF

SEQ ID NO: 587 - protein, 11 aa, Artificial Sequence
  Synthetic construct
EWESYGTEWSS

SEQ ID NO: 588 - protein, 9 aa, Artificial Sequence
  Synthetic construct
SKSEWQQGF

SEQ ID NO: 589 - protein, 11 aa, Artificial Sequence
  Synthetic construct
EWESYGTEWVN

SEQ ID NO: 590 - protein, 9 aa, Artificial Sequence
  Synthetic construct
SKEEWQQGF

SEQ ID NO: 591 - protein, 11 aa, Artificial Sequence
  Synthetic construct
EWESYGTEWSN

SEQ ID NO: 592 - protein, 9 aa, Artificial Sequence
  Synthetic construct
SKSEWQQGF

SEQ ID NO: 593 - protein, 11 aa, Artificial Sequence
  Synthetic construct
EWESFGTEWVN

SEQ ID NO: 594 - protein, 9 aa, Artificial Sequence
  Synthetic construct
SKEEWQQGF

SEQ ID NO: 595 - protein, 8 aa, Artificial Sequence
  Synthetic construct
WGFVWSTY

SEQ ID NO: 596 - protein, 9 aa, Artificial Sequence
  Synthetic construct
PKSNWQQGF

SEQ ID NO: 597 - protein, 8 aa, Artificial Sequence
  Synthetic construct
WGHVWSTY

SEQ ID NO: 598 - protein, 9 aa, Artificial Sequence
  Synthetic construct
PKSNWQQGY

SEQ ID NO: 599 - protein, 8 aa, Artificial Sequence
  Synthetic construct
LGHVWVEQ

SEQ ID NO: 600 - protein, 9 aa, Artificial Sequence
  Synthetic construct
PKSTWQQGW

SEQ ID NO: 601 - protein, 8 aa, Artificial Sequence
  Synthetic construct
LGHVWVGV

SEQ ID NO: 602 - protein, 9 aa, Artificial Sequence
  Synthetic construct
PKSTWQQGW

SEQ ID NO: 603 - protein, 8 aa, Artificial Sequence
  Synthetic construct
LGHVWVHT

SEQ ID NO: 604 - protein, 9 aa, Artificial Sequence
  Synthetic construct
PKSTWQQGW

SEQ ID NO: 605 - protein, 8 aa, Artificial Sequence
  Synthetic construct
WGTVWGTY

SEQ ID NO: 606 - protein, 9 aa, Artificial Sequence
  Synthetic construct
PKSNWQQGY

SEQ ID NO: 607 - protein, 8 aa, Artificial Sequence
  Synthetic construct
LGHVWVGT

SEQ ID NO: 608 - protein, 9 aa, Artificial Sequence
  Synthetic construct
PKSTWQQGW

SEQ ID NO: 609 - protein, 11 aa, Artificial Sequence
  Synthetic construct
  MISC_FEATURE (1)..(1): Xaa = Glu, Leu, Ser, Val, Trp, or Tyr
XWESYGTEWSS

SEQ ID NO: 610 - protein, 11 aa, Artificial Sequence
  Synthetic construct
  MISC_FEATURE (5)..(5): Xaa = Tyr, Phe, Met, Pro, Val, or Trp
WWESXGTEWSS

SEQ ID NO: 611 - protein, 11 aa, Artificial Sequence
  Synthetic construct
  MISC_FEATURE (7)..(7): Xaa = Thr, Asn, or Val
WWESYGXEWSS

SEQ ID NO: 612 - protein, 11 aa, Artificial Sequence
  Synthetic construct
  MISC_FEATURE (8)..(8): Xaa = Glu, Ile, Pro, or Val
WWESYGTXWSS

SEQ ID NO: 613 - protein, 11 aa, Artificial Sequence
  Synthetic construct
  MISC_FEATURE (10)..(10): Xaa = Ser, Ala, Ile, Thr, or Val
WWESYGTEWXS

SEQ ID NO: 614 - protein, 11 aa, Artificial Sequence
  Synthetic construct
  MISC_FEATURE (11)..(11): Xaa = Ser, Asn, Arg, or Thr
WWESYGTEWSX

SEQ ID NO: 615 - protein, 14 aa, Artificial Sequence
  Synthetic construct
  MISC_FEATURE (1)..(1): Xaa = Thr, His, or Ser
XKEEWQQGFVFSCS

SEQ ID NO: 616 - protein, 14 aa, Artificial Sequence
  Synthetic construct
  MISC_FEATURE (3)..(3): Xaa = Glu, Ser, Asp, Gly, Thr, Pro, Gln, or Arg
TKXEWQQGFVFSCS

SEQ ID NO: 617 - protein, 14 aa, Artificial Sequence
  Synthetic construct
  MISC_FEATURE (4)..(4): Xaa = Glu or Arg
TKEXWQQGFVFSCS

SEQ ID NO: 618 - protein, 14 aa, Artificial Sequence
  Synthetic construct
  MISC_FEATURE (9)..(9): Xaa = Phe, His, Lys, or Tyr
TKEEWQQGXVFSCS

SEQ ID NO: 619 - protein, 14 aa, Artificial Sequence
  Synthetic construct
  MISC_FEATURE (12)..(12): Xaa = Ser, Thr, or Trp
TKEEWQQGFVFXCS

SEQ ID NO: 620 - protein, 14 aa, Artificial Sequence
  Synthetic construct
  MISC_FEATURE (14)..(14): Xaa = Ser, Cys, Pro, Met, or Trp
TKEEWQQGFVFSCX

SEQ ID NO: 621 - protein, 5 aa, Artificial Sequence
  Synthetic construct
  misc_feature (2)..(2): Xaa can be any naturally occurring amino acid
  misc_feature (5)..(5): Xaa can be any naturally occurring amino acid
TXWSX

SEQ ID NO: 622 - protein, 181 aa, Artificial Sequence
  Synthetic construct
  MISC_FEATURE (97)..(97): Xaa = Asp or Glu
NSVIIVDKNGRLVYLVENPGGYVAYSKAATVTGKLVHANFGTKKDFEDLDSPVNGSIVIVRAGKITFAEKVANAESLNAIGVLIYMDQTKFPIVNAXLSFFGHAHLGTGDPYTPGFPSFNHTQFPPSRSSGLPNIPVQTISRAAAEKLFGNMEGDCPSDWKTDSTCRMVTSENKNVKLTVS

SEQ ID NO: 623 - protein, 330 aa, Homo sapiens [sequence omitted]

SEQ ID NO: 624 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 625 - protein, 377 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 626 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

What is claimed is:

1. A polypeptide comprising a CH3 domain that specifically binds to a transferrin receptor, wherein the CH3 domain comprises five, six, seven, or eight substitutions in a set of amino acid positions comprising 118, 119, 120, 122, 210, 211, 212, and 213; and (i) wherein the substitutions and the positions are determined with reference to amino acids 114-220 of SEQ ID NO:1 and (ii) the CH3 domain has at least 80% identity to amino acids 114-220 of any one of SEQ ID NOS:30-46.

2. The polypeptide of claim 1, wherein the CH3 domain comprises Gly at position 210; Phe at position 211; and/or Asp at position 213.

3. The polypeptide of claim 1, wherein the CH3 domain comprises at least one position selected from the following: position 118 is Phe or Ile; position 119 is Asp, Glu, Gly, Ala, or Lys; position 120 is Tyr, Met, Leu, Ile, or Asp; position 122 is Thr or Ala; position 210 is Gly; position 211 is Phe; position 212 is His, Tyr, Ser, or Phe; and position 213 is Asp.

4. The polypeptide of claim 1, wherein the CH3 domain comprises Gly at position 210 and Phe at position 211.

5. The polypeptide of claim 1, wherein the CH3 domain comprises Gly at position 210 and Asp at position 213.

6. The polypeptide of claim 1, wherein the CH3 domain comprises Phe at position 211 and Asp at position 213.

7. The polypeptide of claim 1, wherein the CH3 domain comprises Gly at position 210; Phe at position 211; and Asp at position 213.

8. The polypeptide of claim 1, wherein the CH3 domain comprises two, three, four, five, six, seven, or eight positions selected from the following: position 118 is Phe or Ile; position 119 is Asp, Glu, Gly, Ala, or Lys; position 120 is Tyr, Met, Leu, Ile, or Asp; position 122 is Thr or Ala; position 210 is Gly; position 211 is Phe; position 212 is His, Tyr, Ser, or Phe; and position 213 is Asp.

9. The polypeptide of claim 1, wherein the CH3 domain comprises amino acids 118-122 and amino acids 210-213 of any one of SEQ ID NOS:30-46.

10. The polypeptide of claim 9, wherein the CH3 domain comprises amino acids 118-122 and amino acids 210-213 of SEQ ID NO:30 and has at least 90% identity to amino acids 114-220 of SEQ ID NO:30.

11. The polypeptide of claim 9, wherein the CH3 domain comprises amino acids 118-122 and amino acids 210-213 of SEQ ID NO:31 and has at least 90% identity to amino acids 114-220 of SEQ ID NO:31.

12. The polypeptide of claim 9, wherein the CH3 domain comprises amino acids 118-122 and amino acids 210-213 of SEQ ID NO:32 and has at least 90% identity to amino acids 114-220 of SEQ ID NO:32.

13. The polypeptide of claim 9, wherein the CH3 domain comprises amino acids 118-122 and amino acids 210-213 of SEQ ID NO:33 and has at least 90% identity to amino acids 114-220 of SEQ ID NO:33.

14. The polypeptide of claim 9, wherein the CH3 domain comprises amino acids 118-122 and amino acids 210-213 of SEQ ID NO:34 and has at least 90% identity to amino acids 114-220 of SEQ ID NO:34.

15. The polypeptide of claim 9, wherein the CH3 domain comprises amino acids 118-122 and amino acids 210-213 of SEQ ID NO:35 and has at least 90% identity to amino acids 114-220 of SEQ ID NO:35.

16. The polypeptide of claim 9, wherein the CH3 domain comprises amino acids 118-122 and amino acids 210-213 of SEQ ID NO:36 and has at least 90% identity to amino acids 114-220 of SEQ ID NO:36.

17. The polypeptide of claim 9, wherein the CH3 domain comprises amino acids 118-122 and amino acids 210-213 of SEQ ID NO:37 and has at least 90% identity to amino acids 114-220 of SEQ ID NO:37.

18. The polypeptide of claim 9, wherein the CH3 domain comprises amino acids 118-122 and amino acids 210-213 of SEQ ID NO:38 and has at least 90% identity to amino acids 114-220 of SEQ ID NO:38.

19. The polypeptide of claim 9, wherein the CH3 domain comprises amino acids 118-122 and amino acids 210-213 of SEQ ID NO:39 and has at least 90% identity to amino acids 114-220 of SEQ ID NO:39.

20. The polypeptide of claim 9, wherein the CH3 domain comprises amino acids 118-122 and amino acids 210-213 of SEQ ID NO:40 and has at least 90% identity to amino acids 114-220 of SEQ ID NO:40.

21. The polypeptide of claim 9, wherein the CH3 domain comprises amino acids 118-122 and amino acids 210-213 of SEQ ID NO:41 and has at least 90% identity to amino acids 114-220 of SEQ ID NO:41.

22. The polypeptide of claim 9, wherein the CH3 domain comprises amino acids 118-122 and amino acids 210-213 of SEQ ID NO:42 and has at least 90% identity to amino acids 114-220 of SEQ ID NO:42.

23. The polypeptide of claim 9, wherein the CH3 domain comprises amino acids 118-122 and amino acids 210-213 of SEQ ID NO:43 and has at least 90% identity to amino acids 114-220 of SEQ ID NO:43.

24. The polypeptide of claim 9, wherein the CH3 domain comprises amino acids 118-122 and amino acids 210-213 of SEQ ID NO:44 and has at least 90% identity to amino acids 114-220 of SEQ ID NO:44.

25. The polypeptide of claim 9, wherein the CH3 domain comprises amino acids 118-122 and amino acids 210-213 of SEQ ID NO:45 and has at least 90% identity to amino acids 114-220 of SEQ ID NO:45.

26. The polypeptide of claim 9, wherein the CH3 domain comprises amino acids 118-122 and amino acids 210-213 of SEQ ID NO:46 and has at least 90% identity to amino acids 114-220 of SEQ ID NO:46.

27. The polypeptide of claim 1, wherein the CH3 domain comprises amino acids 118-213 of any one of SEQ ID NOS:30-46.

28. The polypeptide of claim 1, wherein the polypeptide comprises the sequence of any one of SEQ ID NOS:30-46 without the first three amino acids "PCP" at the amino-terminal end.

29. The polypeptide of claim 28, wherein the polypeptide comprises the sequence of any one of SEQ ID NOS:30-46.

30. The polypeptide of claim 1, wherein the CH3 domain further comprises (i) a Trp at position 139 or (ii) a Ser at position 139, an Ala at position 141, and a Val at position 180, wherein the amino acid positions are determined with reference to SEQ ID NO: 1.

31. The polypeptide of claim 1, wherein the polypeptide is joined to a CH2 domain.

32. The polypeptide of claim 31, wherein the CH2 domain contains one or both of the following sets of modifications with reference to the amino acid sequence of SEQ ID NO:1:
   (a) Ala at position 7 and at position 8; and
   (b) Tyr at position 25, Thr at position 27, and Glu at position 29.

33. The polypeptide of claim 32, wherein set (a) further comprises Gly at position 102.

34. The polypeptide of claim 31, wherein the polypeptide is further joined to a Fab.

35. A method for engineering a CH3 domain to specifically bind to a transferrin receptor, the method comprising:
   (a) engineering a polynucleotide that encodes the CH3 domain to have at least five amino acid substitutions at a set of amino acid positions comprising 118, 119, 120, 122, 210, 211, 212, and 213,
   wherein the substitutions and positions are determined with reference to amino acids 114-220 of SEQ ID NO:1;
   (b) expressing a polypeptide comprising the engineered CH3 domain; and
   (c) determining whether the engineered CH3 domain binds to the transferrin receptor.

36. The method of claim 35, wherein the polypeptide comprising the engineered CH3 domain is expressed as a soluble protein.

37. The method of claim 35, wherein the steps of expressing the polypeptide comprising the engineered CH3 domain and determining whether the engineered CH3 domain binds to the transferrin receptor are performed using a display system.

38. The method of claim 37, wherein the display system is a cell surface display system, a viral display system, an mRNA display system, a polysomal display system, or a ribosomal display system.

* * * * *